US012036255B2

(12) United States Patent
Maresso et al.

(10) Patent No.: US 12,036,255 B2
(45) Date of Patent: Jul. 16, 2024

(54) BACTERIOPHAGE COMPOSITIONS AND METHODS FOR TREATMENT OF BACTERIAL INFECTIONS

(71) Applicants: Baylor College of Medicine, Houston, TX (US); The United States of America as Represented by the Department of Veterans Affairs, Washington, DC (US)

(72) Inventors: Anthony Maresso, Houston, TX (US); Robert Ramig, Houston, TX (US); Sabrina Green, Houston, TX (US); Austen Terwilliger, Houston, TX (US); Keiko Salazar, Houston, TX (US); Justin R. Clark, Houston, TX (US); Barbara Trautner, Houston, TX (US)

(73) Assignees: Baylor College of Medicine, Houston, TX (US); The United States Government as Represented by the Department of Veterans Affairs, Washington, DC (US)

( * ) Notice: Subject to any disclaimer, the term of this patent is extended or adjusted under 35 U.S.C. 154(b) by 0 days.

(21) Appl. No.: 18/152,077

(22) Filed: Jan. 9, 2023

(65) Prior Publication Data

US 2024/0180980 A1 Jun. 6, 2024

Related U.S. Application Data

(63) Continuation of application No. PCT/US2022/080888, filed on Dec. 5, 2022.

(51) Int. Cl.
*A61K 35/76* (2015.01)
*A61P 31/04* (2006.01)
*C12N 7/00* (2006.01)

(52) U.S. Cl.
CPC ............. *A61K 35/76* (2013.01); *A61P 31/04* (2018.01); *C12N 7/00* (2013.01); *C12N 2795/10132* (2013.01); *C12N 2795/10171* (2013.01); *C12N 2795/10232* (2013.01); *C12N 2795/10271* (2013.01)

(58) Field of Classification Search
CPC ............ A61K 35/76; A61P 31/04; C12N 2795/10232; C12N 7/00; C12N 2795/10132
See application file for complete search history.

(56) References Cited

U.S. PATENT DOCUMENTS

2005/0136037 A1  6/2005  Holland et al.
2014/0199360 A1  7/2014  Donlan et al.

FOREIGN PATENT DOCUMENTS

WO    2020/264096 A1    12/2020
WO    2023/039427 A1    3/2023

OTHER PUBLICATIONS

International Application No. PCT/US2022/080888 filed Dec. 5, 2022.
Gibson et al., "Constructing and Characterizing Bacteriophage Libraries for Phage Therapy of Human Infections," Frontiers in Microbiology, Nov. 12, 2019 (Nov. 12, 2019), vol. 10, pp. 1-14.
International Search Report dated Dec. 29, 2022 during examination of related application PCT/US2022/076048.
Terwilliger et al., "Phage Therapy Related Microbial Succession Associated with Successful Clinical Outcome for a Recurrent Urinary Tract Infection," Viruses, Oct. 12, 2021 (Oct. 12, 2021), vol. 13, No. 13, pp. 1-14.
Green et al: "Bacteriophages from ExPEC Reservoirs Kill Pandemic Multidrug-Resistant Strains of Clonal Group ST131 in Animal Models of Bacteremia", Nature.come, Scientific Reports, 7:46151, published Apr. 12, 2017.
Green et al: "Targeting of Mammalian Glycans Enhances Phage Predation in the Gastrointestinal Tract", American Society for Microbiology, Therapeutics and Prevention, Jan./Feb. 2021, vol. 12, Issue 1, e03474-20, mbio.asm.org.
Salazar et al., Antiviral Resistance and Phage Counter Adaptation to Antibiotic-Resistant Extraintestinal Pathogenic *Escherichia coli*. mBio. Apr. 27, 2021, vol. 12, No. 2, e00211-21, p. 1-20.
International Search Report dated May 4, 2023 during examination of International Appl. No. PCT/US22/80888.

*Primary Examiner* — Janet L Andres
*Assistant Examiner* — Ruixue Wang
(74) *Attorney, Agent, or Firm* — Norton Rose Fulbright US LLP

(57) ABSTRACT

Disclosed are compositions, devices, kits, and methods for treatment of Enterobacteriaceae infection. Aspects of the present disclosure are directed to bacteriophage compositions comprising one or more of ES17, ES19, HP3, HP3.1, and HP3.2. Certain aspects of the disclosure are directed to compositions comprising (a) bacteriophage ES17 or bacteriophage ES19, (b) bacteriophage HP3, and (c) bacteriophage HP3.1. Also disclosed are compositions comprising bacteriophage HP 3.2. Further disclosed are devices and kits comprising such compositions and methods for use of such compositions in treatment and prevention of pathogenic *E. coli* infection.

29 Claims, 22 Drawing Sheets
Specification includes a Sequence Listing.

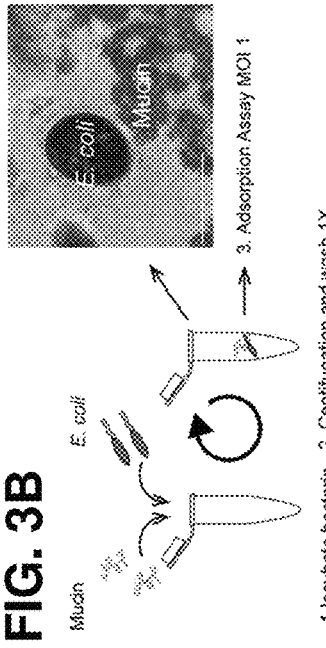
FIG. 3A
FIG. 3B
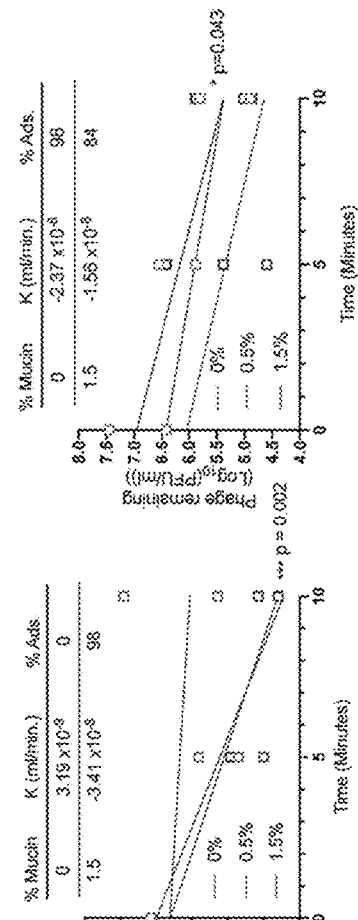
FIG. 3C
FIG. 3D
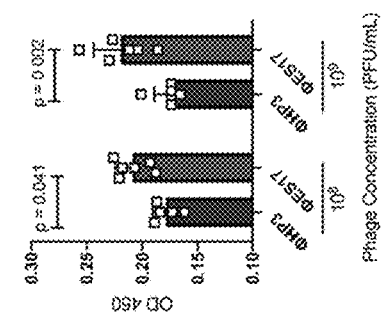
FIG. 3E

FIG. 9A
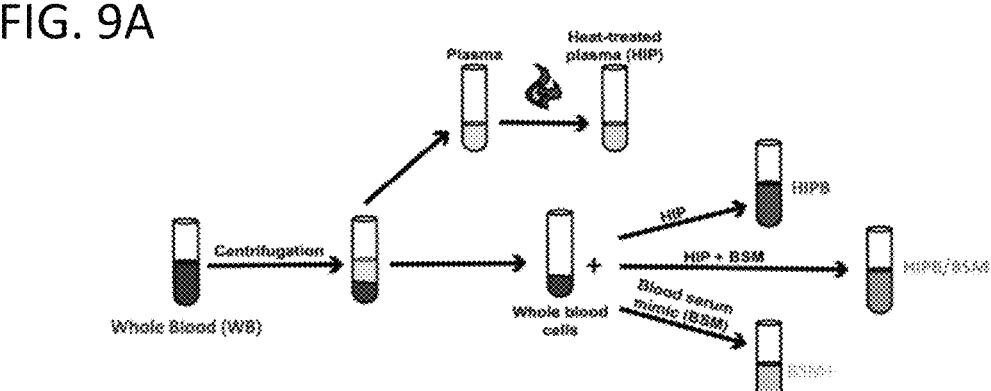
FIG. 9B
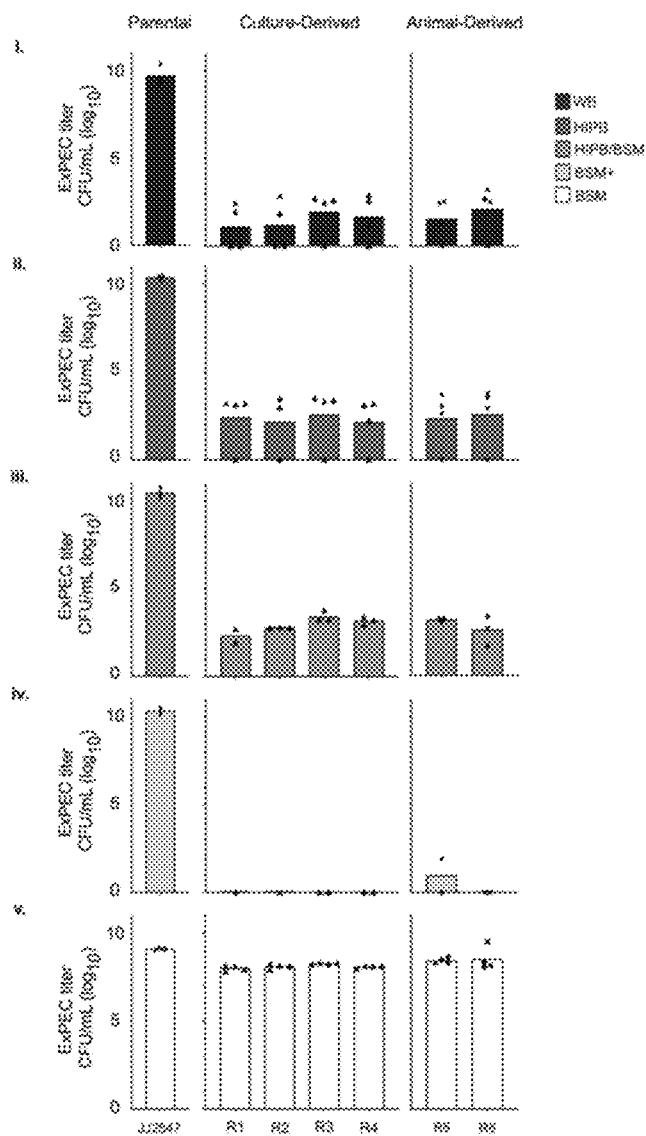
FIG. 9

FIG. 11A
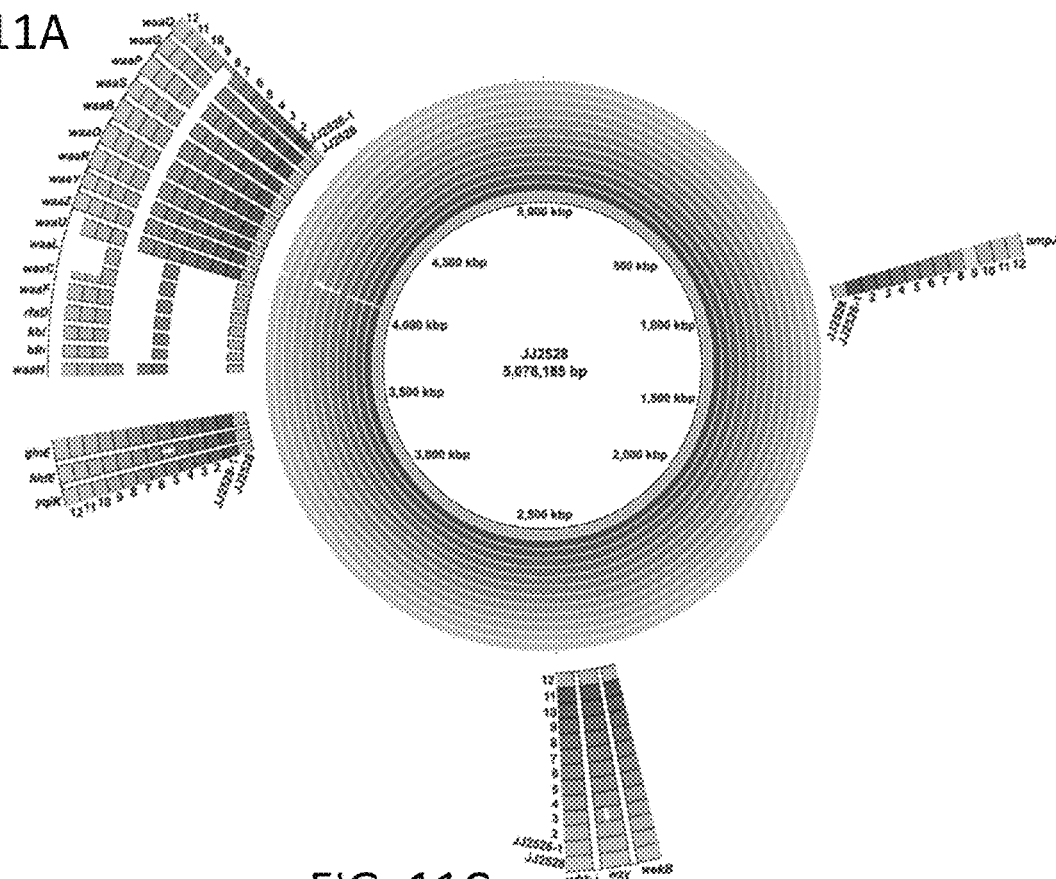
FIG. 11B
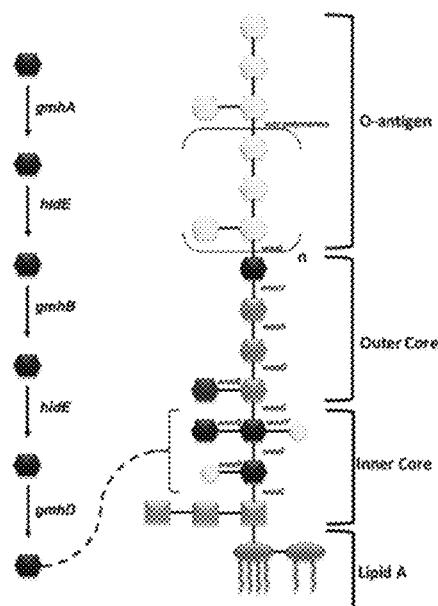
FIG. 11C

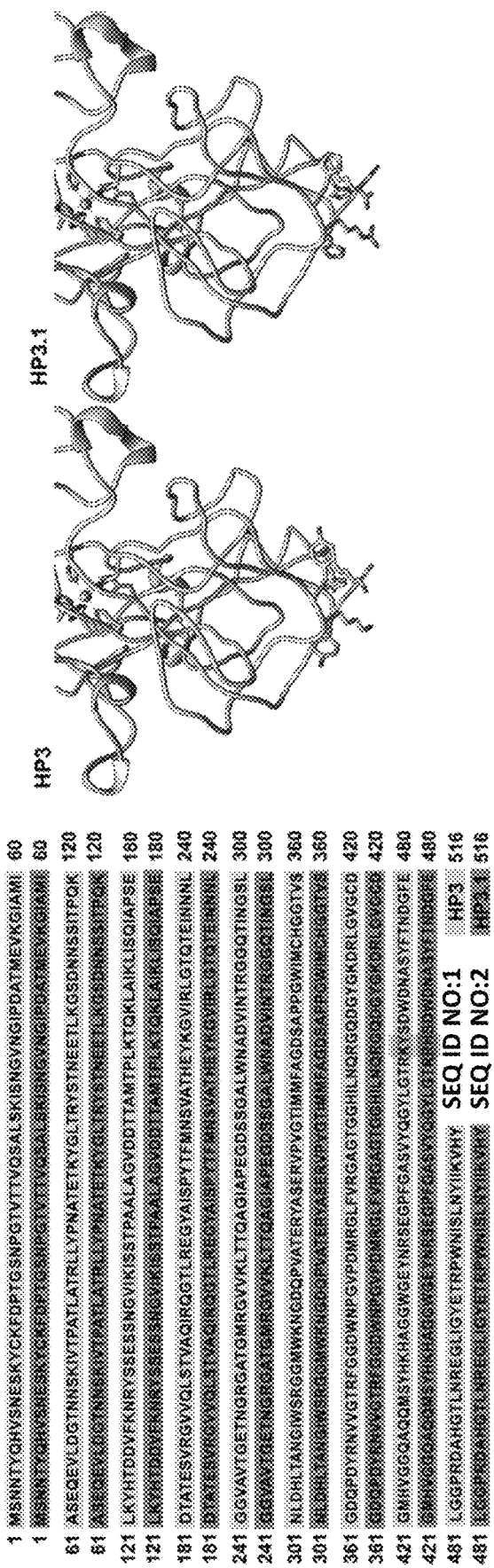

| Isolate | Isolation Strategy | Organ |
|---|---|---|
| JJ2050 | | |
| JJ2050-1 | Culture | |
| JJ2050-2 | Animal | Liver |
| JJ2050-3 | Animal | Spleen |
| JJ2528 | | |
| JJ2528-1 | Culture | |
| JJ2528-2 | Culture | |
| JJ2528-3 | Culture | |
| JJ2528-4 | Culture | |
| JJ2528-5 | Culture | |
| JJ2528-6 | Culture | |
| JJ2528-7 | Culture | |
| JJ2528-8 | Animal | Liver |
| JJ2528-9 | Animal | Liver |
| JJ2528-10 | Animal | Spleen |
| JJ2528-11 | Animal | Liver |
| JJ2528-12 | Animal | Mix |
| JJ2547 | | |
| JJ2547-1 | Culture | |
| JJ2547-2 | Culture | |
| JJ2547-3 | Culture | |
| JJ2547-4 | Culture | |
| JJ2547-5 | Animal | Liver |
| JJ2547-6 | Animal | Spleen |

*FIG. 15*

| ExPEC Isolate | Spot Assay (PFU/mL) | | | | EOP (HP3.1 vs HP3) |
|---|---|---|---|---|---|
| | HP3 | HP3.1 | EC1 | ES17 | |
| JJ2050 | 6.73E10 | 4.74E9 | 5.61E9 | 2.56E10 | 7.04% |
| JJ2050-1 | | 4.16E8 | | | |
| JJ2050-2 | | 3.34E8 | | | |
| JJ2050-3 | | 9.29E8 | | | |
| JJ2528 | 8.32E10 | 4.47E10 | 8.20E9 | 2.07E10 | 53.73% |
| JJ2528-1 | | 3.56E9 | | | |
| JJ2528-2 | | 3.78E9 | | | |
| JJ2528-3 | | 4.45E9 | | | |
| JJ2528-4 | | 5.42E9 | | | |
| JJ2528-5 | | 1.39E9 | | | |
| JJ2528-6 | | 6.61E8 | | | |
| JJ2528-7 | | 6.53E8 | | | |
| JJ2528-8 | | 1.9E9 | | | |
| JJ2528-9 | | 1.93E9 | | | |
| JJ2528-10 | | 1.48E9 | | | |
| JJ2528-11 | | 1.25E9 | | | |
| JJ2528-12 | | 2.47E9 | | | |
| JJ2547 | 3.16E11 | 3.01E10 | 5.80E9 | 3.47E10 | 39.52% |
| JJ2547-1 | | 6.32E9 | | | |
| JJ2547-2 | | 4.27E10 | | | |
| JJ2547-3 | | 9.51E9 | | | |
| JJ2547-4 | | 1.07E10 | | | |
| JJ2547-5 | | 8.13E9 | | | |
| JJ2547-6 | | 2.67E9 | | | |

*FIG. 16*

BACTERIOPHAGE COMPOSITIONS AND METHODS FOR TREATMENT OF BACTERIAL INFECTIONS

CROSS-REFERENCE TO RELATED APPLICATION

This application is a continuation claiming the benefit of priority to International Application No. PCT/US22/80888 filed Dec. 5, 2022, both of which are incorporated herein by reference in their entirety.

SEQUENCE LISTING

The instant application contains a Sequence Listing which has been submitted in XML format and is hereby incorporated by reference in its entirety. Said XML copy, created on Dec. 2, 2022, is named BAYMP0340WO2_SL.xml and is 757,530 bytes in size.

BACKGROUND

I. Field of the Invention

Aspects of this invention relate to at least the fields of microbiology and virology.

II. Background

Multidrug-resistant (MDR) bacteria infect millions of people around the world, yearly. Many of these infections caused by these bacteria have become untreatable due to resistance to last resort antibiotics. Exacerbating this crisis, the pipeline for antibiotic development is slow and resistant strains rapidly develop in the wake of new drugs. The family Enterobacteriaceae provides an urgent threat of MDR infections, due in part to strains of *Escherichia (E.) coli*. Extraintestinal pathogenic *E. coli* (ExPEC), a pathotype of the larger *E. coli* superfamily, is a natural inhabitant of the human gastrointestinal microbiome. ExPEC strains are unique in their ability to translocate and cause subsequent infections in immunocompromised individuals. When they do, they cause an array of serious illnesses including urinary tract infections (UTI), bacteremia, sepsis, and neonatal meningitis. New treatments are needed to contain the threat of MDR bacteria.

A promising response to MDR infections is bacteriophage (phage) therapy. Viruses which infect bacteria, phages are environmentally ubiquitous, host-specific, and effective at infecting MDR bacterial strains. Importantly, they have been shown to be safe and effective in animal and compassionate-use human trials. Because they use the replication machinery of their bacterial host, phage mutation rates are directly influenced by those of that host; as such, phages may rapidly adapt to target strains of bacteria. However, due to the cognate rates of evolution between a phage and its host, a mixed population of phages and bacteria will result in an evolutionary arms race. Consequently, phage-resistant bacteria are likely to develop.

There exists a need for new and improved methods and compositions for treatment of bacterial infections, including *E. coli* infections such as ExPEC.

SUMMARY

Aspects of the present disclosure are directed to bacteriophage compositions, kits and devices comprising such compositions, and methods for use of such compositions for treatment or prevention of pathogenic infections. In some aspects, disclosed is a composition comprising (a) bacteriophage ES17 or bacteriophage ES19, (b) bacteriophage HP3, and (c) bacteriophage HP3.1. In some embodiments, the composition comprises bacteriophages ES17, HP3, and HP3.1. In some embodiments, the composition comprises bacteriophages ES19, HP3, and HP3.1 Also disclosed are compositions comprising bacteriophage HP3.2. Further disclosed are methods of treating or preventing an *E. coli* infection in an individual comprising administering (a) bacteriophage ES17 or bacteriophage ES19, (b) bacteriophage HP3, and (c) bacteriophage HP3.1. Certain aspects disclose methods of treating or preventing an *E. coli* infection in an individual comprising administering bacteriophage HP3.2.

Embodiments of the disclosure include bacteriophages, bacteriophage compositions, kits, devices, medical devices, therapeutic devices, polynucleotides, methods for preparing a device, methods for treatment of an *E. coli* infection, and methods for prevention of an *E. coli* infection. Compositions of the disclosure can include at least 1, 2, 3, or more of the following components: bacteriophage ES17, bacteriophage ES19, bacteriophage HP3, bacteriophage HP3.1, bacteriophage HP3.2, an additional bacteriophage, a metal, and a pharmaceutical excipient. Any one or more of the preceding components may be excluded from certain embodiments. Methods of the disclosure can include at least 1, 2, 3, or more of the following steps: detecting an infection in an individual, diagnosing an individual as having an *E. coli* infection, generating a bacteriophage composition, coating a device with a bacteriophage composition, providing a device to an individual, formulating a bacteriophage composition for therapeutic administration, and administering a bacteriophage composition to an individual. Any one or more of the preceding steps may be excluded from certain embodiments.

Disclosed herein, in some embodiments, is a composition comprising (a) bacteriophage ES17 or bacteriophage ES19, (b) bacteriophage HP3, and (c) bacteriophage HP3.1. In some embodiments, the composition comprises bacteriophage ES17. In some embodiments, the composition comprises bacteriophage ES19. In some embodiments, the composition further comprises HP3.2. In some embodiments, the amount of the bacteriophages in the composition are substantially the same. In some embodiments, the amount of the bacteriophages in the composition are not substantially the same. Also disclosed, in some embodiments, is a composition comprising bacteriophage HP3.2. In some embodiments, the composition further comprises a pharmaceutically acceptable excipient. In some embodiments, the pharmaceutical composition further comprises one or more metals. In some embodiments, the one or more metals comprise calcium, magnesium, iron, sodium, and/or potassium. In some embodiments, the composition is in a liquid formulation. In some embodiments, the composition is in a solid formulation. In some embodiments, the composition is housed in a delivery apparatus. Also disclosed is a method of treating or preventing an *E. coli* infection in an individual, comprising administering to the individual a composition of the disclosure.

Further disclosed herein, in some embodiments, is a device comprising (a) bacteriophage ES17 or bacteriophage ES19, (b) bacteriophage HP3, and (c) bacteriophage HP3.1 that are on, in, and/or around the device. In some embodiments, the device comprises bacteriophage ES17. In some embodiments, the device comprises bacteriophage ES19. In some embodiments, the device further comprises bacteriophage HP3.2. Also disclosed is a device comprising bacteriophage HP3.2 that is on, in, and/or around the device. In some embodiments, the device is a catheter, drive line, syringe, tube, implant, defibrillator, artificial joint, pacemaker, screw, rod, disc, intrauterine device, pin, plate, stent, dental device, eye lens, shunt, valve, neurological or neurosurgical device, gastrointestinal device, genitourinary device, catheter cuff, vascular access device, or wound drain. In some embodiments, the device is further defined as having a coating comprising the bacteriophages.

Also disclosed herein, in some embodiments, is a kit comprising (a) bacteriophage ES17 or bacteriophage ES19, (b) bacteriophage HP3, and (c) bacteriophage HP3.1, housed in a suitable container. In some embodiments, the kit comprises bacteriophage ES17. In some embodiments, the kit comprises bacteriophage ES19. In some embodiments, the kit further comprises HP3.2. Also disclosed is a kit comprising bacteriophage HP3.2. In some embodiments, the kit further comprises a device. In some embodiments, the device comprises the bacteriophages. In some embodiments, the bacteriophages are separate from the device.

Disclosed herein, in some embodiments, is a method of treating or preventing an E. coli infection in an individual, comprising the step of administering to the individual (a) bacteriophage ES17 or bacteriophage ES19, (b) bacteriophage HP3, and (c) bacteriophage HP3.1. In some embodiments, the method comprises administering bacteriophage ES17. In some embodiments, the method comprises administering bacteriophage ES19. In some embodiments, the method further comprises administering to the individual the bacteriophage HP3.2. In some embodiments, the bacteriophages are in the same formulation. In some embodiments, the bacteriophages are not in the same formulation. In some embodiments, each of the bacteriophages are administered to the individual at the same time. In some embodiments, each of the bacteriophages are administered to the individual at different times. In some embodiments, the bacteriophages are administered to the individual intravenously, orally, and/or upon a device. In some embodiments, the bacteriophages are administered multiple times to the individual. In some embodiments, the bacteriophages are administered once a day, twice a day, once a week, twice a week, once a month, or twice a month. In some embodiments, the bacteriophages are administered twice a week for 6-12 weeks. Also disclosed is a method of treating or preventing an E. coli infection in an individual, comprising the step of administering to the individual the bacteriophage HP3.2.

In some embodiments, the individual has an infection in the urinary tract, blood, gut, abdomen, stomach, lungs, skin, kidneys, prostate, bladder, brain, vaginal tract, heart, liver, spleen, or a combination thereof. In some embodiments, the individual has a catheter-associated urinary tract infection. In some embodiments, the E. coli is multidrug-resistant. In some embodiments, the E. coli is an extraintestinal pathogenic E. coli. In some embodiments, the E. coli is ST69, ST73, ST96, or ST131. In some embodiments, the E. coli is ST131. In some embodiments, the individual has a urinary tract infection, neonatal meningitis, a blood-stream infection, pneumonia, sepsis, a surgical wound infection, a skin infection, a prostate infection, meningitis, a vaginal infection or a combination thereof. In some embodiments, the individual has diarrhea, stomach cramping, nausea, and/or vomiting. In some embodiments, the individual is immunosuppressed. In some embodiments, the individual has an immune cell defect, asplenia, impaired splenic function, nephrotic syndrome, or an autoimmune condition. In some embodiments, the individual is administered the bacteriophages prior to a medical procedure or regimen. In some embodiments, the individual will be subject to immunosuppressive conditions. In some embodiments, the individual is taking or will be taking chemotherapy. In some embodiments, the individual is taking or will be taking an immunosuppressant. In some embodiments, the immunosuppressant is a glucocorticoid, a calcineurin inhibitor, an antimetabolite, or an antibody therapy. In some embodiments, the medical procedure comprises insertion of a device in the individual. In some embodiments, the source of the E. coli was from a beverage, comestible, another individual, or an environment. In some embodiments, the environment is ground or surface water, water used to irrigate crops, a public water system, a hospital, a school, a nursing home, a petting zoo, a cruise ship, a train, or an airplane. In some embodiments, the individual is at a higher risk for E. coli infection than the general population. In some embodiments, the individual is younger than 12 years of age or is 65 years of age or older. In some embodiments, the individual is 1, 2, 3, 4, 5, 6, 7, 8, 9, 10, 11, or 12 years of age. In some embodiments, the individual is 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 years of age, or older. In some embodiments, the individual has consumed undercooked meat, unpasteurized milk, apple juice or cider; or soft cheese made from raw milk. In some embodiments, the individual is taking a medication to reduce stomach acid (e.g., a proton pump inhibitor).

Also disclosed herein, in some embodiments, is a method of reducing the level of a drug-resistant and/or pathogenic E. coli strain in an individual, comprising the step of administering to the individual a therapeutically effective amount of (a) bacteriophage ES17 or bacteriophage ES19, (b) bacteriophage HP3, and (c) bacteriophage HP3.1. In some embodiments, the method comprises administering bacteriophage ES17. In some embodiments, the method comprises administering bacteriophage ES19. In some embodiments, administering to the individual a therapeutically effective amount of the bacteriophage HP3.2. Also disclosed, in some embodiments, is a method of reducing the level of a drug-resistant and/or pathogenic E. coli strain in an individual, comprising the step of administering to the individual a therapeutically effective amount of the bacteriophage HP3.2. In some embodiments, the reduction is in the intestine of the individual. In some embodiments, the individual has been subject to insertion of a device or will be subjected to insertion of a device. In some embodiments, the individual will be subject to immunosuppressive conditions. In some embodiments, the E. coli strain is an extraintestinal pathogenic E. coli. In some embodiments, the E. coli strain is ST69, ST73, ST96, or ST131. In some embodiments, the E. coli strain is ST131.

Further described herein, in some embodiments, is a method of preparing a device, comprising the step of subjecting a device to (a) bacteriophage ES17 or bacteriophage ES19, (b) bacteriophage HP3, and (c) bacteriophage HP3.1. In some embodiments, the method comprises subjecting the device to bacteriophage ES17. In some embodiments, the method comprises subjecting the device to bacteriophage ES19. In some embodiments, the bacteriophages are placed on, in, and/or around the device. In some embodiments, one or more surfaces of the device are coated with the bacteriophages. In some embodiments, the device is a catheter, drive line, syringe, tube, implant, defibrillator, artificial joint, pacemaker, screw, rod, disc, intrauterine device, pin, plate, stent, dental device, or eye lens. In some embodiments, the method further comprises delivering the device to an individual in need thereof.

Throughout this application, the term "about" is used to indicate that a value includes the inherent variation of error for the measurement or quantitation method.

The use of the word "a" or "an" when used in conjunction with the term "comprising" may mean "one," but it is also consistent with the meaning of "one or more," "at least one," and "one or more than one."

The phrase "and/or" means "and" or "or". To illustrate, A, B, and/or C includes: A alone, B alone, C alone, a combination of A and B, a combination of A and C, a combination of B and C, or a combination of A, B, and C. In other words, "and/or" operates as an inclusive or.

The words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

The compositions and methods for their use can "comprise," "consist essentially of," or "consist of" any of the ingredients or steps disclosed throughout the specification. Compositions and methods "consisting essentially of" any of the ingredients or steps disclosed limits the scope of the claim to the specified materials or steps which do not materially affect the basic and novel characteristic of the claimed invention.

"Individual, "subject," and "patient" are used interchangeably and can refer to a human or non-human.

Any method in the context of a therapeutic, diagnostic, or physiologic purpose or effect may also be described in "use" claim language such as "Use of" any compound, composition, or agent discussed herein for achieving or implementing a described therapeutic, diagnostic, or physiologic purpose or effect.

It is specifically contemplated that any limitation discussed with respect to one embodiment of the invention may apply to any other embodiment of the invention. Furthermore, any composition of the invention may be used in any method of the invention, and any method of the invention may be used to produce or to utilize any composition of the invention. Any embodiment discussed with respect to one aspect of the disclosure applies to other aspects of the disclosure as well and vice versa. For example, any step in a method described herein can apply to any other method. Moreover, any method described herein may have an exclusion of any step or combination of steps. Aspects of an embodiment set forth in the Examples are also embodiments that may be implemented in the context of embodiments discussed elsewhere in a different Example or elsewhere in the application, such as in the Summary, Detailed Description, Claims, and Brief Description of the Drawings.

Other objects, features and advantages of the present invention will become apparent from the following detailed description. It should be understood, however, that the detailed description and the specific examples, while indicating specific embodiments of the invention, are given by way of illustration only, since various changes and modifications within the spirit and scope of the invention will become apparent to those skilled in the art from this detailed description.

BRIEF DESCRIPTION OF THE DRAWINGS

The following drawings form part of the present specification and are included to further demonstrate certain aspects of the present invention. The invention may be better understood by reference to one or more of these drawings in combination with the detailed description of specific embodiments presented herein.

(FIG. 1A) Mice were orally gavaged on day 0 with $10^9$ CFU of ExPEC JJ1901 and then monitored for colonization by plating fecal pellets for colony counts on selective medium (LB plus chloramphenicol). Starting on day 1, groups received either daily phage dose ($10^9$ PFU), phage in water ($10^9$ PFU/ml), or antibiotic (ABX), 2 mg/ml ampicillin in water, until day 5. On day 6, mice were euthanized and their organs were homogenized and plated for CFU levels or PFU levels (plaque assay). (FIG. 1B) Intestinal (fecal) colonization of ExPEC. Colored dots represent means. ExPEC plus phage gavage, ExPEC1U(G); ExPEC plus phage in water, ExPEC1U(W); ExPEC plus antibiotic in water, ExPEC1ABX(W). (FIG. 1C) Intestinal tissue and contents phage levels. (FIG. 1D) Intestinal tissue and contents ExPEC levels. N=8 to 10. Open squares represent individual mice, bars represent means. #, missing values due to histological analysis. (FIG. 1E) ExPEC levels after 4.5 h of growth (shaking, 37° C.) in LB, fecal medium, or cecal medium with or without phage (MOI 10). (FIG. 1F) PFU counts of phage HP3 after 4.5 h of growth in different medium. Open squares represent independent cultures (N=3). Bars represent means±standard deviation (SD). NS, not significant; ", none detected. One-way ANOVA used for statistical analysis.

(FIG. 2A) Cecal medium (CM) was prepared, heat treated (HT CM) at 100° F. for 20 min or centrifuged (6,000×g; 5 min), filtered (0.22-mm filter treated or FT), and then used for a 4.5-h growth assay. (FIG. 2B) Cecal medium was centrifuged at a high speed (9,000×g, 5 min) separated into pellet (insoluble [Ins]) and supernatant (soluble [Sol]). The Ins was resuspended in saline±NAC (N-acetyl cysteine, 5 mg/ml), the soluble±mucin (porcine gastric mucin, 1% [wt/vol]). ExPEC levels are after a 4.5-h assay. (FIG. 2C) ExPEC levels following a 4.5-h assay screen with phages in mucin (1.5% [wt/vol] in LB). For all experiments, MOI of 10. Open squares represent independent cultures. Mean (bars) 6SD shown throughout, N=3 to 9. ", none detected. One-way ANOVA used for statistical analysis.

FIGS. 3A-3E. (FIG. 3A) Transmission electron microscopy (TEM) image of phage ES17. (FIG. 3B) Mucin (0%, 0.5% and 1.5% [wt/vol]) was added to the ExPEC cultures for 10 min at RT with shaking (255 rpm). The cultures were centrifuged (6,000×g for 5 min) and gently washed with PBS. Adsorption curve (MOI, 1) was constructed using mid-log-phase cultures and samples taken every 5 min for 10 min. ExPEC coated with mucin pictured in TEM image. White bar, 1 mm. (FIG. 3C) Adsorption phage ES17. (FIG. 3D) Adsorption phage HP3. Adsorption constant (K) and percent adsorbed (% Ads) in 10 min for 0% and 1.5% mucin indicated above the curves. Regression lines generated from mean values of phage remaining for time points indicated. Open squares represent individual values from separate cultures. Dashed lines, 0% mucin; red lines, 0.5% mucin; blue lines, and 1.5% mucin in bacteria. Two biological replicates for 0% and 1.5%. (FIG. 3E) ELISA with 1.5% mucin-coated wells. Different phages were incubated overnight on coated wells and then washed, and the assay was performed. Open squares represent biological replicates. Different concentrations of phages incubated on wells indicated on x axis. N=6. Bars represent means±SD shown throughout. Simple linear regression was used to calculate if slope is significantly nonzero for FIGS. 3C and 3D. Two-way ANOVA used for statistical analysis in FIG. 3E.

(FIG. 4A) No phage added (i), phage ES17 added (ii), and phage HP3 added (iii). (FIG. 4B) To selectively removed HSPG from GAG chains, enteroid cultures were pretreated with heparinase III (Hep III; 2 U/ml) for 2 h at 37° C., 5% $CO_2$, in a humidified incubator and then incubated with or without phage as described above. No phage (i and ii), phage ES17 added (iii), phage HP3 added (iv), Hep III-treated HIEMs incubated with ES17 (v), and Hep III-treated HIEMs incubated with HP3 (vi). Image magnification, ×60. (vii) Quantification of particles (phage) per well using FIJI software. Means±SDs shown (N=1 to 2). Open squares represent independent cultures. One-way ANOVA used for statistical analysis. FIG. 4B created with BioRender software.

(FIG. 5A) ExPEC levels after 4.5-h growth assay in cecal medium or LB (MOI, 10). Bars indicate the means, and open squares represent independent cultures. N=3. (FIG. 5B) Mice were orally gavaged on day 0 with $10^9$ CFU of ExPEC JJ1901. Starting on day 1, mice received either daily dose (gavage) of phages (HP3 or ES17 at $10^{10}$ PFU) or none until day 5. On day 6, mice were euthanized and their organs were homogenized and plated for CFU levels or plaque assay for PFU levels. (FIG. 5C) Intestinal (tissue) and contents phage levels. (FIG. 5D) Intestinal (tissue) and contents ExPEC levels. N=10 mice per group. Bars indicate the means±SD, and open squares indicate individual mice. ", none detected. One-way ANOVA used for statistical analysis.

(FIG. 7A) Resisters were isolated using either a culture- or murine-based method. In both cases, parental strains were subjected to selective pressure in the presence of ϕHP3. (FIG. 7B) Isolate titers were determined in liquid culture after 4.5 h of incubation in LB, with or without the presence of ϕHP3. Panel B is grouped by parental isolate: JJ2050 (i), JJ2528 (ii), and JJ2547 (iii). P values were determined by Student t test or Mann-Whitney test, where necessary. *, P, 0.05; , P, 0.01; *, P, 0.01. Bars represent the average titers. Each data point represents the average of three parallel technical replicates.

FIGS. 9A and 9B. (FIG. 9A) Human whole blood was separated by centrifugation and the plasma heat-treated to inactivate complement. The whole blood cells (WBCs) were then resuspended in heat-treated plasma (HIP), blood serum mimic (BSM), or a 1:1 mix of HIP and BSM. (FIG. 9B) JJ2547 and resisters' titers were determined after 24 h of incubation in different blood media: whole blood (WB, dark red) (i), HIP blood (HIPB, red) (ii), HIP/BSM blood (HIPB/BSM, orange) (iii), BSM (BSM1, light orange) (iv), or BSM with no blood cells (BSM, white) (v). P values were determined by Student t test or Mann-Whitney test, where necessary. *, P<0.05; , P<0.01; *, P<0.01. Each data point represents the average of three parallel technical replicates.

(FIG. 10A) Swiss-Webster mice were infected with $3.5 \times 10^7$ CFU log-phage cultures, suspended in PBS. Animals were observed for 72 h and then euthanized unless moribund. Livers and spleens were homogenized and plated to determine bacterial burden. (FIG. 10B) Animals infected with the parental isolate showed a survival rate of only 20%, whereas the resister-infected animals had a survival rate of 100%. (FIG. 10C) Infected animals were observed and given a health score using the four parameters outlined in the NIH Animal Research Advisory Committee Guidelines. A score of 4 or greater is considered moribund and requires euthanasia. (FIG. 10D) Livers and spleens of infected animals were collected after euthanasia, weighed, homogenized, and plated on LB to determine bacterial burden. Shown is the titer per gram weight. The P values in FIG. 10B were determined by log-rank (Mantel-Cox) test. P values in FIG. 10D were determined by a Student t test or Mann-Whitney test, where necessary. *, P<0.05; , P<0.01; *, P<0.01.

FIGS. 11A-11C. The genomes of all 21 resisters and their parental isolates were sequenced. (FIG. 11A) JJ2528 and its resistant isolates were aligned to reveal several truncations of interest, particularly in the waa operon, hldE, and ompA. Dashed fill for panel indicates the downstream SNP in ompA. (FIG. 11B) Structure of LPS, naming the enzyme responsible for forming each linkage. Also shown are several steps in the construction of LD-Hep (left).

(FIG. 12A) Resister JJ2528-12 was used as a target for the evolution of ϕHP3. ϕHP3 was allowed to adapt to the target in a continuous-flow bioreactor, in a method similar to the Appelman's protocol. (FIG. 12B) Isolate titers were determined in liquid culture after 4.5 h of incubation in LB with or without the presence of the evolved ϕHP3.1 (top panels). The ϕHP3.1 titer was also determined on these isolates using a standard phage spot assay (bottom panels). FIG. 12B is grouped by parental isolate: JJ2050 (i), JJ2528 (ii), and JJ2547 (iii). The P values were determined by a Student t test or Mann-Whitney test, where necessary. *, P<0.05; , P<0.01; *, P<0.01. Each data point represents the average of three parallel technical replicates.

FIGS. 13A and 13B. (FIG. 13A) Sequencing revealed a key missense mutation in the binding spike of ϕHP3.1 (red highlight). (FIG. 13B) Residue substitutions were determined to be located at the binding region of the tail protein by protein modeling, based on the structure of the tail spike of ϕT4.

(FIG. 14A) Phage (ϕHP3 and ϕHP3.1) titers were determined by spot assay on the parental isolate and primary and secondary resisters. (FIG. 14B) Isolate titers were determined in liquid culture after 4.5 h of incubation in LB (black) or urine (yellow), with or without the presence of either ϕHP3 or ϕHP3.1. (FIG. 14C) Whole-genome sequencing was performed on the secondary resisters, and they were aligned with the parental isolate and primary resisters. The secondary resisters retained truncations in the waa operon and acquired truncations in ompA. A dashed fill for panel indicates the downstream SNP in ompA. The P values in FIGS. 14A and 14B were determined by a Student t test or Mann-Whitney test, where necessary. *, P<0.05; , P<0.01; *, P<0.01. Each data point represents the average of three parallel technical replicates.

FIG. 15 shows phage-resistant isolates. A total of 21 combined ϕHP3-resistant isolates were collected from the three parental isolates and two selection methods. Each isolate and its source is listed.

FIG. 16 shows results from a phage screen against resistant isolates. Resisters were screened against ϕHP3, ϕHP3.1, ϕEC1 (similar to ϕHP3), and ϕES17 (dissimilar to ϕHP3) by phage spot assay. The phage titer is shown, where applicable. Green squares indicate plaque formation, and red squares indicate resistance to the phage. The ϕHP3.1 efficiency of plating is shown relative to that of ϕHP3 on parental ExPEC isolates.

FIG. 17A shows growth of $E.\ coli$ (measured by OD600) treated with a phage cocktail of HP3 and ES17. FIG. 17B shows growth of $E.\ coli$ treated with a phage cocktail of ϕHP3, ϕHP3.1, and ϕHP3.2.

DETAILED DESCRIPTION OF THE INVENTION

Figure 1A:
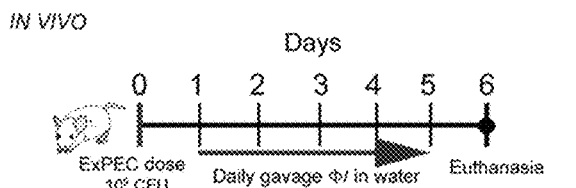
FIGS. 1A-1F.

The present disclosure is based, at least in part, on the discovery and development of novel bacteriophages and bacteriophage combinations for treatment and prevention of $E.\ coli$ infection, including multidrug-resistant (MDR) $E.\ coli$ infection. Accordingly, disclosed herein, in some embodiments, are bacteriophage compositions comprising one or more of ES17, ES19, HP3, HP3.1, and HP3.2. Certain aspects of the disclosure are directed to compositions comprising (a) bacteriophage ES17 or bacteriophage ES19, (b) bacteriophage HP3, and (c) bacteriophage HP3.1. Also disclosed are compositions comprising bacteriophage HP3.2. Further disclosed are devices and kits comprising such compositions and methods for use of such compositions in treatment and prevention of pathogenic $E.\ coli$ infection.

I. Bacteriophage Compositions

Aspects of the disclosure are directed to compositions comprising one or more bacteriophage. As used herein, a "bacteriophage composition" describes any composition comprising one or more bacteriophage (also "phage"). A bacteriophage of the present disclosure may be a lytic phage. A bacteriophage of the present disclosure may be a phage capable of infecting one or more pathogenic bacteria. A bacteriophage of the present disclosure may be a phage capable of infecting one or more bacteria of the family Enterobacteriaceae. In some embodiments, a bacteriophage of the disclosure is a phage capable of infecting $Escherichia\ coli$ ($E.\ coli$), such as a multidrug-resistant (MDR) $E.\ coli$ and/or extraintestinal pathogenic $E.\ coli$ (ExPEC). A bacteriophage composition may comprise, for example, a bacteriophage generated using a method or system described in PCT Publication No. WO 2020/264096, titled "Systems And Methods For Generating Bacteriophages Adapted To Infect A Target Bacterial Strain", incorporated herein by reference in its entirety.

A bacteriophage composition of the disclosure may comprise, for example, one or more bacteriophage capable of lysing a pathogenic bacteria. A bacteriophage composition of the present disclosure may comprise at least, at most, or exactly 1, 2, 3, 4, 5, 6, 7, 8, 9, or 10 different bacteriophages, or more. In some embodiments, a bacteriophage composition of the disclosure comprises one or more of ES17, ES19, HP3, HP3.1, and HP3.2. In some embodiments, a bacteriophage composition of the disclosure comprises ES17. In some embodiments, a bacteriophage composition of the disclosure comprises ES19. In some embodiments, a bacteriophage composition of the disclosure comprises HP3. In some embodiments, a bacteriophage composition of the disclosure comprises HP3.1. In some embodiments, a bacteriophage composition of the disclosure comprises HP3.2. In some embodiments, a bacteriophage composition comprises two or more of ES17, ES19, HP3, HP3.1, and HP3.2. In some embodiments, a bacteriophage composition comprises three or more of ES17, ES19, HP3, HP3.1, and HP3.2. In some embodiments, a bacteriophage composition comprises four or more of ES17, ES19, HP3, HP3.1, and HP3.2. In some embodiments, a bacteriophage composition comprises (a) ES17 or ES19, (b) HP3, and (c) HP3.1. In some embodiments, a bacteriophage composition comprises ES17, HP3, and HP3.1. In some embodiments, a bacteriophage composition comprises ES19, HP3, and HP3.1. In some embodiments, a bacteriophage composition comprises ES17, HP3, HP3.1, and HP3.2. In some embodiments, a bacteriophage composition comprises ES19, HP3, HP3.1, and HP3.2. In some embodiments, a bacteriophage composition comprises ES17, ES19, HP3, HP3.1, and HP3.2.

A bacteriophage composition of the disclosure may comprise, in addition to one or more of ES17, ES19, HP3, HP3.1, and HP3.2, one or more additional bacteriophages (e.g., additional bacteriophages capable of lysing pathogenic $E.\ coli$). Additional bacteriophages contemplated herein include, but are not limited to, bacteriophages EC1, CF2, ES12, ES21, and ES26, which bacteriophages are described in, for example, Gibson SB, Green SI, Liu CG, et al. Constructing and Characterizing Bacteriophage Libraries for Phage Therapy of Human Infections. Front Microbiol. 2019; 10:2537, incorporated herein by reference in its entirety.

A bacteriophage composition of the disclosure may comprise, in addition to one or more bacteriophages, one or more metals. The one or more metals may include, for example, calcium, magnesium, iron, sodium, and/or potassium. A bacteriophage composition comprising two or more different bacteriophages may comprise various amounts of each bacteriophage. For example, a composition may comprise substantially the same amount of each bacteriophage. Alternatively, a composition may comprise substantially different amounts of each bacteriophage.

A bacteriophage composition may comprise at least, at most, or about $10^3$, $10^4$, $10^5$, $10^6$, $10^7$, $10^8$, $10^9$, $10^{10}$, $10^{11}$, or $10^{12}$ plaque forming units (PFU) of each of the one or more bacteriophage in the composition, or more. In some embodiments, a bacteriophage composition comprises at least, at most, or about $10^3$, $10^4$, $10^5$, $10^6$, $10^7$, $10^8$, $10^9$, $10^{10}$, $10^{11}$, or $10^{12}$ PFU of ES17. In some embodiments, a bacteriophage composition comprises at least, at most, or about $10^3$, $10^4$, $10^5$, $10^6$, $10^7$, $10^8$, $10^9$, $10^{10}$, $10^{11}$, or $10^{12}$ PFU of ES19. In some embodiments, a bacteriophage composition comprises at least, at most, or about $10^3$, $10^4$, $10^5$, $10^6$, $10^7$, $10^8$, $10^9$, $10^{10}$, $10^{11}$, or $10^{12}$ PFU of HP3. In some embodiments, a bacteriophage composition comprises at least, at most, or about $10^3$, $10^4$, $10^5$, $10^6$, $10^7$, $10^8$, $10^9$, $10^{10}$, $10^{11}$, or $10^{12}$ PFU of HP3.1. In some embodiments, a bacteriophage composition comprises at least, at most, or about $10^3$, $10^4$, $10^5$, $10^6$, $10^7$, $10^8$, $10^9$, $10^{10}$, $10^{11}$, or $10^{12}$ PFU of HP3.2.

A. ES17

Aspects of the present disclosure comprise bacteriophage ES17 (also "*Escherichia* phage ES17," "φES17," or "ES17," used synonymously herein), compositions, kits, and devices comprising ES17, and methods for use. An ES17 genome sequence is described by GenBank® accession number MN508615 and provided as SEQ ID NO: 3.

B. ES19

Aspects of the present disclosure comprise bacteriophage ES19 (also "*Escherichia* phage ES19," "φES19," or "ES19," used synonymously herein), compositions, kits, and devices comprising ES19, and methods for use. An ES19 genome sequence is described by GenBank® accession number MN508616 and provided as SEQ ID NO: 7.

C. HP3

Aspects of the present disclosure comprise bacteriophage HP3 (also "*Escherichia* phage HP3," "φHP3," or "HP3," used synonymously herein), compositions, kits, and devices comprising HP3, and methods for use. An HP3 genome sequence is described by GenBank® accession number NC_041920 and provided as SEQ ID NO: 4.

D. HP3.1

Aspects of the present disclosure comprise bacteriophage HP3.1 (also "*Escherichia* phage HP3," "φHP3.1," or "HP3.1," used synonymously herein), compositions, kits, and devices comprising HP3.1, and methods for use. The HP3.1 genome sequence is described by GenBank® accession number OK275722.1 and provided as SEQ ID NO: 5.

E. HP3.2

Aspects of the present disclosure comprise bacteriophage HP3.2 (also "*Escherichia* phage HP3," "φHP3.2," or "HP3.2," used synonymously herein), compositions, kits, and devices comprising HP3.2, and methods for use. The HP3.2 genome sequence is provided as SEQ ID NO: 6.

II. Treatment and Prevention of Bacterial Infection

Aspects of the present disclosure are directed to methods for treatment and prevention of a bacterial infection in an individual. In some embodiments, disclosed are methods for treatment or prevention of an *E. coli* infection in an individual. In particular aspects, the present disclosure provides methods for treatment or prevention of an *E. coli* infection in an individual comprising administering to the individual an effective amount of one or more bacteriophages, including bacteriophages disclosed herein. Bacteriophages useful for such treatment methods include those described herein, for example ES17, ES19, HP3, HP3.1, and/or HP3.2. Accordingly, in some embodiments, disclosed herein is a method for treatment or prevention of an *E. coli* infection in an individual comprising administering to the individual an effective amount of ES17, ES19, HP3, HP3.1, and/or HP3.2. In some embodiments, the method comprises administering (a) ES17 or ES19, (b) HP3, and (c) HP3.1. In some embodiments, the method comprises administering ES17, HP3, and HP3.1. In some embodiments, the method comprises administering ES17, HP3, and HP3.2. In some embodiments, the method comprises administering HP3.2. In some embodiments, the method comprises administering ES17, HP3, HP3.1, and HP3.2. In some embodiments, the method comprises administering ES19, HP3, HP3.1, and HP3.2. In some embodiments, the method comprises administering ES17, ES19, HP3, HP3.1, and HP3.2.

In some embodiments, multiple bacteriophage (e.g., two or more of ES17, ES19, HP3, HP3.1, and HP3.2) are administered to an individual in the same formulation. Alternatively, multiple bacteriophage may be administered to an individual in different formulations (e.g., 2, 3, or more formulations). Multiple bacteriophage may be administered to an individual at the same time or may be administered at different times.

Multiple bacteriophage may be administered to an individual substantially simultaneously, for example via a single composition. For example, ES17, HP3, and HP3.1 may be administered to an individual having a pathogenic *E. coli* infection at the same time, as a single composition. As another example, ES19, HP3, and HP3.1 may be administered to an individual having a pathogenic *E. coli* infection at the same time, as a single composition. As yet another example, ES17, HP3, HP3.1, and HP3.2 may be administered to an individual having a pathogenic *E. coli* infection at the same time, as a single composition. As a further example, ES19, HP3, HP3.1, and HP3.2 may be administered to an individual having a pathogenic *E. coli* infection at the same time, as a single composition.

Multiple bacteriophage may be administered to an individual sequentially in any order. For example, an individual having a pathogenic *E. coli* infection may be administered ES17, followed by HP3, followed by HP3.1. Example administration sequences of ES17, HP3, and HP3.1 include: ES17, HP3, HP3.1; HP3, ES17, HP3.1; HP3.1, ES17, HP3; ES17, HP3.1, HP3; HP3, HP3.1, ES17; and HP3.1, HP3, ES17. Example administration sequences of ES19, HP3, and HP3.1 include ES19, HP3, HP3.1; HP3, ES19, HP3.1; HP3.1, ES19, HP3; ES19, HP3.1, HP3; HP3, HP3.1, ES19; and HP3.1, HP3, ES19. Example administration sequences of ES17, HP3, HP3.1, and HP3.2 include: ES17, HP3, HP3.1, HP3.2; HP3, ES17, HP3.1, HP3.2; HP3.1, ES17, HP3, HP3.2; ES17, HP3.1, HP3, HP3.2; HP3, HP3.1, ES17, HP3.2; HP3.1, HP3, ES17, HP3.2; HP3.1, HP3, HP3.2, ES17; HP3.2, HP3, ES17, HP3.1; HP3, HP3.2, ES17, HP3.1; ES17, HP3.2, HP3, HP3.1; HP3, ES17, HP3.2, HP3.1; ES17, HP3, HP3.2, HP3.1; HP3.2, HP3.1, HP3, ES17; HP3.1, HP3.2, HP3, ES17; HP3; HP3.1, ES17, HP3.2, HP3; HP3.2, ES17, HP3.1, HP3; ES17, HP3.2, HP3.1, HP3; HP3.1, HP3.2, ES17, HP3; HP3.2, HP3.1, ES17, HP3; HP3.2, HP3.1, HP3, ES17; HP3.1, HP3.2, HP3, ES17; HP3.2, HP3, HP3.1, ES17; HP3.1, HP3, HP3.2, ES17; and HP3, HP3.1, HP3.2, ES17. Example administration sequences of ES19, HP3, HP3.1, and HP3.2 include ES19, HP3, HP3.1, HP3.2; HP3, ES19, HP3.1, HP3.2; HP3.1, ES19, HP3, HP3.2; ES19, HP3.1, HP3, HP3.2; HP3, HP3.1, ES19, HP3.2; HP3.1, HP3, ES19, HP3.2; HP3.2, HP3, ES19, HP3.1; HP3, HP3.2, ES19, HP3.1; ES19, HP3.2, HP3, HP3.1; HP3.2, ES19, HP3, HP3.1; HP3, HP3.1; HP3.2, ES19, HP3, HP3.1; HP3, ES19, HP3.2, HP3.1; ES19, HP3, HP3.2, HP3.1; ES19, HP3.1, HP3.2, HP3; HP3.1, ES19, HP3.2, HP3; HP3.2, ES19, HP3.1, HP3; ES19, HP3.2, HP3.1, HP3; HP3.1, HP3.2, ES19, HP3; HP3.2, HP3.1, ES19, HP3; HP3.2, HP3.1, HP3, ES19; HP3.1, HP3.2, HP3, ES19; HP3, HP3.2, HP3.1, ES19; HP3.2, HP3, HP3.1, ES19; HP3.1, HP3, HP3.2, ES19; and HP3, HP3.1, HP3.2, ES19. One or more of the preceding administration sequences may be excluded from embodiments of the disclosure.

Bacteriophages of the disclosure may be administered to an individual once, or may be administered multiple times (e.g., 2, 3, 4, 5, 6, 7, 8, 9, 10, 11, 12, 13, 14, 15, or more times). Bacteriophages may be administered via an appropriate treatment regimen for an appropriate length of time, e.g., for effective treatment or prevention of a pathogenic *E. coli* infection. For example, a bacteriophage composition may be administered to an individual 1, 2, 3, or 4 times per day (or more); 1, 2, 3, 4, 5, 6, or 7 times per week (or more); or 1, 2, 3, 4, 5, 6, 7, 8, 9, 10, 11, 12, 13, 14, 15, 16, 17, 18, 19, or 20 times per month (or more). A bacteriophage composition may be administered for at least, at most, or exactly 1, 2, 3, 4, 5, 6, 7, 8, 9, 10, 11, 12, 13, or 14 days (or more); 1, 2, 3, 4, 5, 6, 7, 8, 9, 10, 11, 12, 13, 14, 15, 16, 17, 18, 19, 20, or 21 weeks (or more); or 1, 2, 3, 4, 5, 6, 7, 8, 9, 10, 11, or 12 months (or more). In some embodiments, a bacteriophage is administered twice per week for between 6 and 12 weeks.

An individual receiving a treatment of the disclosure may have an infection in, for example, one or more of a urinary tract, blood, gut, abdomen, stomach, lungs, skin, kidneys, prostate, bladder, brain, vaginal tract, heart, liver, and spleen. In some embodiments, an individual has a urinary tract infection. In some embodiments, an individual has a catheter-associated urinary tract infection. An individual may have one or more of a urinary tract infection, neonatal meningitis, a blood-stream infection, pneumonia, sepsis, a surgical wound infection, a skin infection, a prostate infection, meningitis, and a vaginal infection. An individual may have one or more symptoms of a pathogenic infection, for example diarrhea, stomach cramping, nausea, and/or vomiting. In some embodiments, an individual does not have any symptoms of a pathogenic infection.

In some embodiments, an individual receiving a treatment of the disclosure has an *E. coli* infection. In some embodiments, an individual has been diagnosed with an *E. coli* infection. In some embodiments, an individual has one or more symptoms of an *E. coli* infection (including, e.g., diarrhea, stomach cramping, nausea, and/or vomiting). In some embodiments, the individual does not have any symptoms of an *E. coli* infection. In some embodiments, the *E. coli* is multidrug-resistant (i.e. is a multidrug-resistant *E. coli*). In some embodiments, the *E. coli* is an extraintestinal pathogenic *E. coli*. Extraintestinal pathogenic *E. coli* are described in, for example, Smith J L, Fratamico P M, Gunther N W. Extraintestinal pathogenic *Escherichia coli*. *Foodborne Pathog Dis.* 2007; 4(2):134-163, incorporated herein by reference in its entirety. An individual may have received an *E. coli* infection from various sources. For example, in some embodiments, the *E. coli* was from a beverage, comestible (e.g., undercooked meat, unpasteurized milk, apple juice or cider; or soft cheese made from raw milk), another individual, or an environment (e.g., ground or surface water, water used to irrigate crops, a public water system, a hospital, a school, a nursing home, a petting zoo, a cruise ship, a train, or an airplane).

An individual receiving a treatment of the disclosure may be an immunosuppressed individual. An immunosuppressed individual may be an individual having, for example, an immune cell defect, asplenia, impaired splenic function, nephrotic syndrome, or an autoimmune condition. An immunosuppressed individual may be an individual subject to immunosuppressive conditions, for example chemotherapeutic agents or immunosuppressant agents (e.g., a glucocorticoid, a calcineurin inhibitor, an antimetabolite, a medication to reduce stomach acid such as a proton pump inhibitor, or an antibody therapy). Accordingly, in certain embodiments, bacteriophages of the disclosure may be administered to an individual before, during, and/or after subjecting the individual to immunosuppressive conditions. For example, bacteriophages of the disclosure (e.g., ES17, ES19, HP3, HP3.1, and/or HP3.2) may be administered to an individual having cancer during treatment with chemotherapy, thereby treating or preventing a pathogenic *E. coli* infection.

III. Devices

Also contemplated herein, in some embodiments, are devices (e.g., medical devices) comprising one or more bacteriophages or bacteriophage compositions of the present disclosure. A device of the disclosure may comprise one or more of ES17, ES19, HP3, HP3.1, and HP3.2. In some embodiments, the device comprises (a) ES17 or ES19, (b) HP3, and (c) HP3.1. In some embodiments, the device comprises ES17, HP3, and HP3.1. In some embodiments, the device comprises ES19, HP3, and HP3.1. In some embodiments, the device comprises HP3.2. In some embodiments, the device comprises ES17, HP3, HP3.1, and HP3.2. In some embodiments, the device comprises ES19, HP3, HP3.1, and HP3.2. A device is described herein as "comprising" a bacteriophage or bacteriophage composition where the device has in, on, or around it, or is attached to, the bacteriophage or bacteriophage composition. In some embodiments, a device of the disclosure is a medical device. In such cases, it may be desirable for a medical device to comprise bacteriophages capable of treating or preventing a pathogenic infection, such as an *E. coli* infection. Various medical devices are recognized in the art and contemplated herein. Examples of devices contemplated herein include, but are not limited to, a catheter, drive line, syringe, tube, implant, defibrillator, artificial joint, pacemaker, screw, rod, disc, intrauterine device, pin, plate, stent, dental device, eye lens, shunt, valve, neurological or neurosurgical device, gastrointestinal device, genitourinary device, catheter cuff, vascular access device, and wound drain. In some embodiments, the device is a stent. In some embodiments, the device is a catheter. In some embodiments, the device is an implant.

Aspects of the disclosure comprise methods for preparing a device comprising subjecting a device to a bacteriophage composition of the disclosure (e.g., a bacteriophage composition comprising ES17, HP3, and HP3.1). Disclosed are methods comprising placing a bacteriophage composition on a device, placing a bacteriophage composition around a device, placing a bacteriophage composition in a device, and coating a device with a bacteriophage composition (e.g., coating one or more surfaces of a device). Aspects further comprise delivering the device to an individual following such preparation.

IV. Pharmaceutical Compositions

In certain aspects, the compositions or agents for use in the disclosed methods, such as bacteriophage(s) (e.g., ES17, ES19, HP3, HP3.1, and/or HP3.2), are suitably contained in a pharmaceutically acceptable carrier. In some embodiments, the carrier is non-toxic, biocompatible and is selected so as not to detrimentally affect the biological activity of the agent. The agents in some aspects of the disclosure may be formulated into preparations for local delivery (i.e. to a specific location of the body) or systemic delivery, in solid, semi-solid, gel, liquid or gaseous forms such as tablets, capsules, powders, granules, ointments, solutions, depositories, inhalants and injections allowing for oral, parenteral or surgical administration. Certain aspects of the disclosure also contemplate local administration of the compositions by coating medical devices and the like.

Suitable carriers for parenteral delivery via injectable, infusion or irrigation and topical delivery include distilled water, physiological phosphate-buffered saline, normal or lactated Ringer's solutions, dextrose solution, Hank's solution, or propanediol. In addition, sterile, fixed oils may be employed as a solvent or suspending medium. For this purpose any biocompatible oil may be employed including synthetic mono- or diglycerides. In addition, fatty acids such as oleic acid find use in the preparation of injectables. The carrier and agent may be compounded as a liquid, suspension, polymerizable or non-polymerizable gel, paste or salve.

The carrier may also comprise a delivery vehicle to sustain (i.e., extend, delay or regulate) the delivery of the agent(s) or to enhance the delivery, uptake, stability or pharmacokinetics of the therapeutic agent(s). Such a delivery vehicle may include, by way of non-limiting examples, microparticles, microspheres, nanospheres or nanoparticles composed of proteins, liposomes, carbohydrates, synthetic organic compounds, inorganic compounds, polymeric or copolymeric hydrogels and polymeric micelles.

In certain aspects, the actual dosage amount of a composition administered to a patient or subject can be determined by physical and physiological factors such as body weight, severity of condition, the type of disease being treated, previous or concurrent therapeutic interventions, idiopathy of the patient and on the route of administration. The practitioner responsible for administration will, in any event, determine the concentration of active ingredient(s) in a composition and appropriate dose(s) for the individual subject.

Solutions of pharmaceutical compositions can be prepared in water suitably mixed with a surfactant, such as hydroxypropylcellulose. Dispersions also can be prepared in glycerol, liquid polyethylene glycols, mixtures thereof and in oils. Under ordinary conditions of storage and use, these preparations contain a preservative to prevent the growth of microorganisms.

In certain aspects, the pharmaceutical compositions are advantageously administered in the form of injectable compositions either as liquid solutions or suspensions; solid forms suitable or solution in, or suspension in, liquid prior to injection may also be prepared. These preparations also may be emulsified. A typical composition for such purpose comprises a pharmaceutically acceptable carrier. For instance, the composition may contain 10 mg or less, 25 mg, 50 mg or up to about 100 mg of human serum albumin per milliliter of phosphate buffered saline. Other pharmaceutically acceptable carriers include aqueous solutions, non-toxic excipients, including salts, preservatives, buffers and the like.

Examples of non-aqueous solvents are propylene glycol, polyethylene glycol, vegetable oil and injectable organic esters such as ethyloleate. Aqueous carriers include water, alcoholic/aqueous solutions, saline solutions, parenteral vehicles such as sodium chloride, Ringer's dextrose, etc. Intravenous vehicles include fluid and nutrient replenishers. Preservatives include antimicrobial agents, antifungal agents, anti-oxidants, chelating agents and inert gases. The pH and exact concentration of the various components the pharmaceutical composition are adjusted according to well-known parameters.

Additional formulations are suitable for oral administration. Oral formulations include such typical excipients as, for example, pharmaceutical grades of mannitol, lactose, starch, magnesium stearate, sodium saccharine, cellulose, magnesium carbonate and the like. The compositions take the form of solutions, suspensions, tablets, pills, capsules, sustained release formulations or powders.

In further aspects, the pharmaceutical compositions may include classic pharmaceutical preparations. Administration of pharmaceutical compositions according to certain aspects may be via any common route so long as the target tissue is available via that route. This may include oral, nasal, buccal, rectal, vaginal or topical. Alternatively, administration may be by orthotopic, intradermal, subcutaneous, intramuscular, intraperitoneal or intravenous injection. Such compositions would normally be administered as pharmaceutically acceptable compositions that include physiologically acceptable carriers, buffers or other excipients. For treatment of conditions of the lungs, aerosol delivery can be used. Volume of the aerosol may be between about 0.01 ml and 0.5 ml, for example.

An effective amount of the pharmaceutical composition is determined based on the intended goal. The term "unit dose" or "dosage" refers to physically discrete units suitable for use in a subject, each unit containing a predetermined-quantity of the pharmaceutical composition calculated to produce the desired responses discussed above in association with its administration, i.e., the appropriate route and treatment regimen. The quantity to be administered, both according to number of treatments and unit dose, depends on the protection or effect desired.

Precise amounts of the pharmaceutical composition also depend on the judgment of the practitioner and are peculiar to each individual. Factors affecting the dose include the physical and clinical state of the patient, the route of administration, the intended goal of treatment (e.g., alleviation of symptoms versus cure) and the potency, stability and toxicity of the particular therapeutic substance.

A. Other Agents

It is contemplated that other agents may be used in combination with certain aspects of the present embodiments to improve the therapeutic efficacy of treatment. These additional agents include agents having antibacterial properties (e.g., antibiotics). For example, one or more therapeutic phage of the disclosure may be used in combination with one or more antibiotics. Various antibiotics are recognized in the art and contemplated herein including, for example, ceftazidime, ciprofloxacin, kanamycin, colistin (polymyxin E), trimethoprim, cefepime, sulfamethoxazole, levofloxacin, and polymyxin B.

V. Kits

Certain aspects of the present disclosure also concern kits containing compositions of the disclosure or compositions to implement methods disclosed herein. In some embodiments, kits can be used to evaluate one or more biomarkers. In certain embodiments, a kit contains, contains at least or contains at most 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 100, 500, 1,000 or more probes, primers or primer sets, synthetic molecules or inhibitors, or any value or range and combination derivable therein. In some embodiments, there are kits for evaluating biomarker activity in a cell.

Kits may comprise components, which may be individually packaged or placed in a container, such as a tube, bottle, vial, syringe, or other suitable container means.

Individual components may also be provided in a kit in concentrated amounts; in some embodiments, a component is provided individually in the same concentration as it would be in a solution with other components. Concentrations of components may be provided as 1×, 2×, 5×, 10×, or 20× or more.

In some embodiments, kits of the disclosure comprise one or more bacteriophages housed in a suitable container. A kit may comprise, comprise at least, or comprise at most 1, 2, 3, 4, 5, 6, 7, 8, 9, or 10 different bacteriophages, or more. In some embodiments, a kit of the disclosure comprises 1, 2, 3, 4, or all of ES17, ES19, HP3, HP3.1, and HP3.2. One or more phage may be specifically excluded from certain embodiments. In some embodiments, a kit of the disclosure comprises ES17, HP3, and HP3.1. In some embodiments, a kit of the disclosure comprises ES19, HP3, and HP3.1. In some embodiments, a kit of the disclosure comprises HP3.2. In some embodiments, a kit of the disclosure comprises ES17, HP3.1, and HP3.2. In some embodiments, a kit of the disclosure comprises ES19, HP3, HP3.1, and HP3.2. In some embodiments, a kit of the disclosure comprises ES17, HP3, HP3.1, and HP3.2. Phage may be housed in a suitable container. A kit of the disclosure may further comprise a device. A kit may comprise a device having one or more bacteriophages of the disclosure on, in, and/or around the device. A kit may comprise a device separate from one or more bacteriophages.

EXAMPLES

The following examples are included to demonstrate certain embodiments of the invention. It should be appreciated by those of skill in the art that the techniques disclosed in the examples which follow represent techniques discovered by the inventor to function well in the practice of the invention, and thus can be considered to constitute certain modes for its practice. However, those of skill in the art should, in light of the present disclosure, appreciate that many changes can be made in the specific embodiments which are disclosed and still obtain a like or similar result without departing from the spirit and scope of the invention.

Figure 1B:
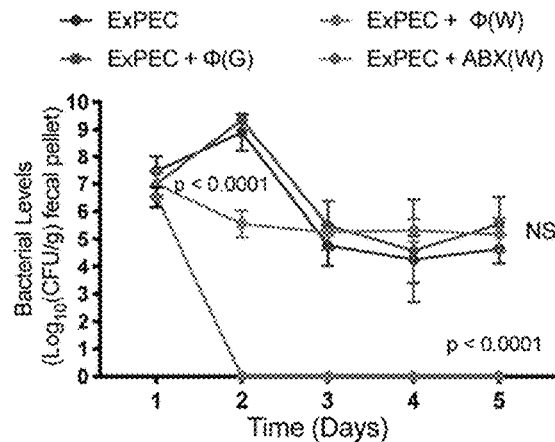
Figure 1C:
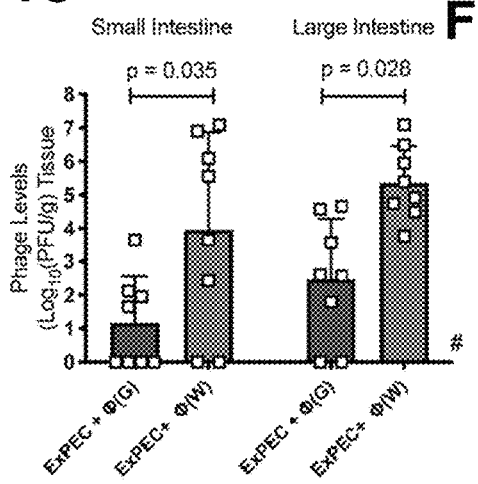
Figure 1D:
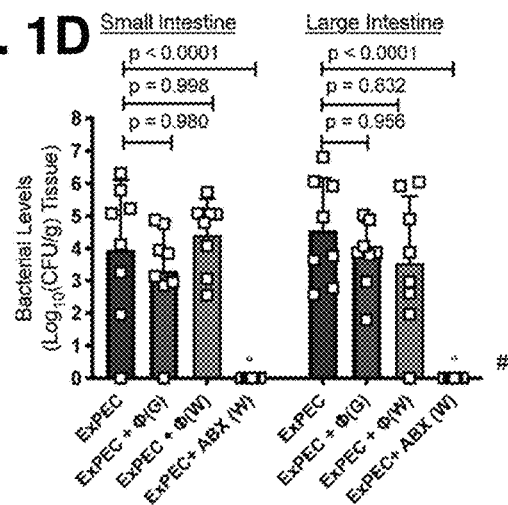
Figure 1E:
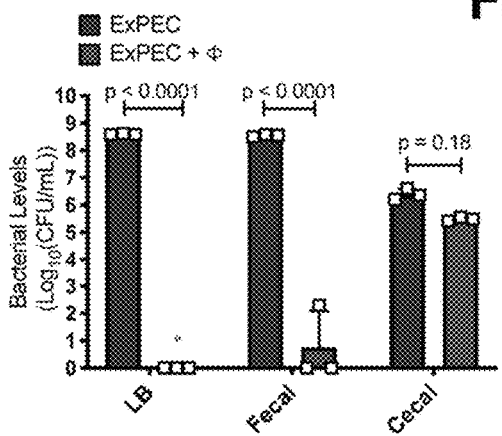
Figure 1F:
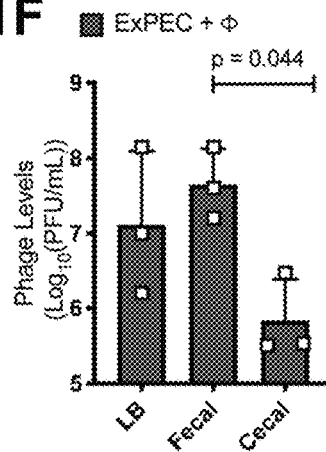

Example 1—Targeting of Mammalian Glycans Enhances Phage Predation in the Gastrointestinal Tract The gastrointestinal tract is prohibitive to phage therapy. Previous studies reported that phage HP3, a lytic myovirus isolated from environmental reservoirs of ExPEC, reduces ST131 bacteremia and disease severity in murine models of infection. Since the human gastrointestinal tract is the primary reservoir of ExPEC ST131, the inventors wondered if phage HP3 could act prophylactically to reduce or eliminate ExPEC burden in the intestine. To test this, mice were orally gavaged with an ExPEC ST131 clinical isolate JJ1901, and then treated with phage or an antibiotic as illustrated in FIG. 1A. Untreated mice sustained stable bacterial colonization during the course of the experiment (6 days) (FIG. 1B). When phage HP3 was given to animals via water or a daily gavage, the levels of ExPEC were indistinguishable from that of the untreated control at the end of the experiment. An uptick in CFU was noted on day 2; however, all groups leveled out by day 3 until the end of the experiment. No ExPEC was detected at any time point in the antibiotic-treated group. Interestingly, phage HP3 was detected and active as determined via plaque assay by plating the stool of phage-treated mice on an overlay of ExPEC bacteria, even on day 4, indicating that the lack of ExPEC reduction was not due to a lack of delivery to the intestinal environment or to inactivation of the phage. It should also be noted that despite having higher levels of phage upon gavage during days 1 to 4, the phage was no more effective at removing ExPEC than phage given in the water, suggesting that in this experiment, there was no dose-dependent effect of phage. In addition, as many as $10^5$ PFU/g phage were found in the murine intestinal tissue (including cecum and colon) on day 6, the final day of the study, yet there was little to no clearing of ExPEC compared to that in these tissues of the untreated control FIGS. 1C and 1D. Importantly, antibiotic treatment significantly reduced the number of operational taxonomic units (OTUs) and diversity, as determined by the Shannon diversity index, which takes into account species richness and distribution (P=0.007, P=0.009). Also, a principal-component analysis (PCA) of beta diversity demonstrated that mice in the antibiotic cohort clustered together and away from the untreated and phage groups, suggesting antibiotics had a more profound effect on the microbiome than phage. Finally, the inventors assessed phage killing in a modified "cecal medium" (CM) that is derived from the cecal contents from recently euthanized mice. These cecal contents were pooled and homogenized in sterile saline solution and then centrifuged to remove large particulates. This medium is designed to simulate the luminal complexity of the mammalian intestine, since it contains fecal matter, a microbiome, mucus, and likely many of the small molecules and proteins present in an intestinal lumen. Whereas phage HP3 completely abolished ExPEC in LB (nearly a 9-log drop in levels and no detectable live bacteria) and nearly abolished it in a slurry of fecal pellets taken from the same murine host (~8-log drop in levels), there was little to no phage-based killing in CM, despite recovering nearly $10^6$ to $10^{7.5}$ PFU/ml of phage FIGS. 1E and 1F These results mirrored those from the ExPEC colonization model and indicate there is a factor(s) present in the mammalian GI that inhibits this lytic phage.

Figure 2A:
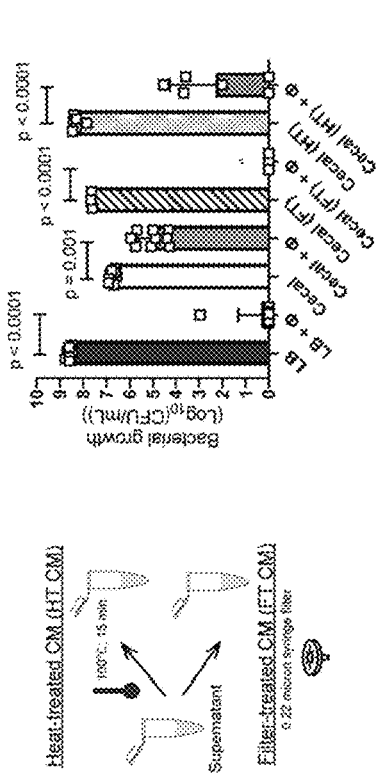
FIGS. 2A-2C.

The inhibitory component is mucin. The inventors wished to understand the reasons phage HP3 was ineffective in this intestinal microenvironment. The inventors next tested whether the inhibition might be related to the presence of live bacterial microbiota in CM. However, ExPEC killing with phage was not enhanced with removal of the microbiota with a broad range of antibiotics, including inhibitors of protein synthesis, cell wall, and DNA synthesis. (Note that the antibiotics efficiently killed a commensal, antibiotic-sensitive, E. coli that was spiked into the CM). Arriving at no resolution as to what the inhibitory factor may be, the inventors decided to test more drastic treatments for their ability to restore phage killing in CM. First, the CM was heat treated (HT CM) (FIG. 2A). Interestingly, heat treatment led to a 0.6-log improvement in ExPEC killing by phage HP3 (P<0.0001) Similarly, when CM was filter treated (0.22-mm filter) (FT CM), there was no detectable level of ExPEC in the medium after treatment with phage HP3 (FIG. 2A), and this observation was extended to another phage showing inhibition in CM, EC1 (P<0.0001). Thus, the inhibitory component was large (retained on 0.22-mm filter) and sensitive to boiling.

Figure 2B:
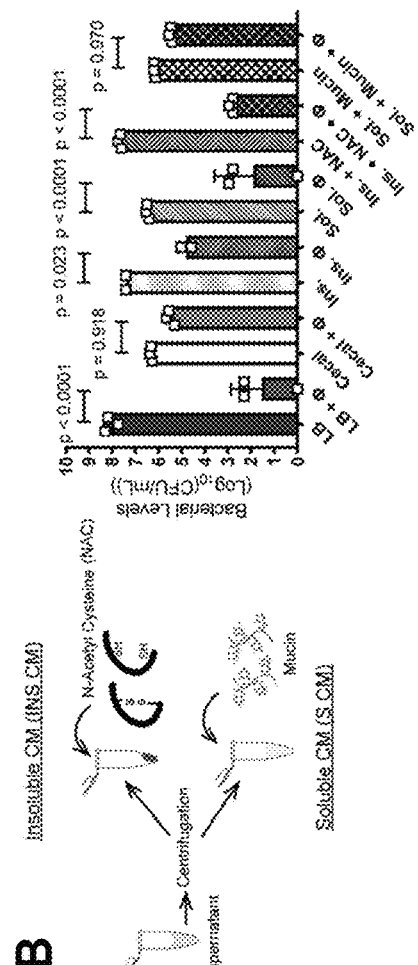

The inventors reasoned intestinal mucins might fit this profile due to their highly associative and sticky properties (captured on a filter), and as proteins, they would be sensitive to heat. Mucins are glycoproteins found throughout the gastrointestinal system which form a layer between the intestinal epithelial cells (IECs) and the commensal or pathogenic microbiota. Also, they can function as receptors for microbes. To test whether mucins were inhibiting bacterial killing by phage, the inventors devised another method whereby CM was separated via high-speed centrifugation into soluble (S CM) and insoluble (INS CM) forms (FIG. 2B). The inventors hypothesized that INS CM would contain mucin, since large intestinal mucins are normally present in this portion, and be inhibitory to phage killing, whereas the S CM would not have these properties. Indeed, phage killing in unprocessed CM or INS CM was inhibited to a greater extent than in S CM (FIG. 2B). To more directly test the hypothesis that mucin was the inhibitory factor, the mucolytic drug N-acetyl cysteine (NAC) was added to INS CM, and porcine gastric mucin (1.5% [wt/vol]) was added to S CM. Indeed, a 5-log reduction in phage killing of ExPEC was observed in INS CM upon addition of NAC, which also improved killing to that seen in S CM (P<0.0001). Perhaps more compelling, the addition of mucin to S CM abrogated bacterial killing by phage to levels originally observed in CM alone (not significant, P=0.970). These results indicate that the inhibitor of phage killing in cecal medium is intestinal mucin.

Along these lines, *E. coli* is known to use mucins as a source of carbon. The inventors reasoned that a murine host colonized with ExPEC may see a bloom upon NAC treatment due to the drug liberating the mucins for bacterial consumption and thus serve as a system to test if the reduction in aggregated mucin would promote phage HP3's ability to kill ExPEC. Upon treatment with NAC for 2 weeks, ExPEC levels in the small intestine of mice were increased, and phage HP3 reduced ExPEC levels, although it was not significant. A similar trend was observed in the large intestine. The less pronounced effect in the large intestine compared to that in the small intestine may be due to the thickness of mucus and thus the lower likelihood for NAC to be effective at breaking up this mucus. Also, NAC is known to be rapidly absorbed in the small intestinal tissue, thereby losing its effect in the more distal large intestine.

Figure 2C:
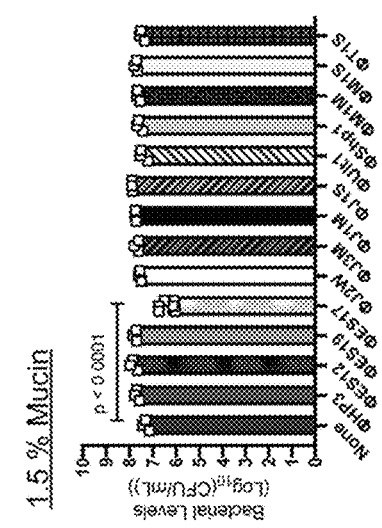

Discovery of a mucin-enhanced phage. Reasoning that human sewage or the feces of animals may contain phage that have evolved to target their host in high mucin environments, such as the intestinal tract, the inventors screened their phage library and other phages recently isolated from these environments for enhanced activity in LB containing 1.5% mucin (FIG. 2C). This is the same concentration that prevented phage HP3 activity in soluble cecal medium and was shown to provide strong inhibition in LB for up to 8 h. Surprisingly, only a single phage, designated phage ES17 (GenBank® Accession No. MN508615), significantly reduced bacteria in the LB mucin medium (FIG. 2C) (P<0.0001, approximately 1 log). Phage ES17 was active in mucin despite being much less effective (0.3 log) than phages HP3, J2W, Ult1, Shp1, or MIS, which completely killed ExPEC to undetectable levels in LB medium alone. Consistent with these data, when the amount of mucin was varied from 0% to 2% and phages HP3 and ES17 were compared for lytic activity against ExPEC, phage HP3 was highly effective as the concentration of mucin was lowered to 0.5% but completely inhibited at higher levels. However, phage ES17 was most effective at concentrations in which HP3 was inactive (0.5% to 1% mucin) and least active at concentrations lower or higher than in this range. Taken together, these data suggest that phage ES17 harbors unique properties that facilitate its ability to efficiently be lytic in the presence of mucin.

Phage ES17 is a C3-type phage whose activity is enhanced by mucin. The inventors sought to understand the molecular mechanism of phage ES17's enhanced ability to find and lyse its bacterial host in mucin. Phage ES17 was determined to be a double-stranded (dsDNA) virus of the order Caudovirales, family Podoviridae, genus Kuravirus. PhiEco32, another Kuravirus phage, shows close genetic similarity to ES17. Kuravirus phages have elongated C3-type capsids, an uncommon morphology, short tail fibers, and small genomes. ES17 has these similar morphological characteristics (capsid of 0.100 nm) (FIG. 3A). ES17 has a small genome size consisting of 75,007 bp with 123 predicted open reading frames (ORFs) (MN508615).

To determine why this phage is distinct from other phages that lack activity in mucin-rich environments, the inventors examined the ability of phages ES17 and HP3 to adsorb to their *E. coli* hosts. Previous data had shown that 98% of HP3 was adsorbed in 10 min, whereas only 32% of ES17 was adsorbed in that time. Additionally, no major differences were previously found between ES17 and HP3 as determined by one-step growth curve parameters such as burst size (ES17, 36; HP3, 60) or latent period (ES17, 32 min; HP3, 22.5 min). The inventors wondered whether the addition of mucin could improve phage ES17 adsorption and inhibit the adsorption of phage HP3. A modified adsorption assay was utilized for this experiment using ExPEC and mucin. Briefly, the bacteria were incubated in different concentrations of mucin (0% to 1.5%), pelleted, and washed to remove any mucin that did not adhere to the bacterial surface (FIG. 3B). Next, a standard adsorption assay was conducted with phages ES17 and HP3. Interestingly, phage ES17 showed no adsorption to ExPEC in 10 min in the absence of mucin; however, if first incubated with 1.5% mucin, adsorption increased to 98% (FIG. 3C). In contrast, 98% of phage HP3 was adsorbed without mucin, and the adsorption dropped to 84% in its presence (FIG. 3D). Finally, the inventors adapted an enzyme-linked immunosorbent assay (ELISA)-like approach to determine if phage ES17 preferred binding to surfaces coated with mucin, a hypothesis consistent with the inventors' data. Indeed, when mucin was bound to an ELISA plate, phage ES17 bound to the mucin surface at higher levels than phage HP3 (FIG. 3E) (P=0.041 and P=0.002). Taken together, using these different approaches, the data suggest that phage ES17 binds mucin, a property that may enhance its ability to infect *E. coli* in mucin-rich environments.

Phage ES17 binds human heparan sulfated proteoglycans. Phage ES17 harbors an enhanced ability relative to that of other *E. coli* phages to find its bacterial host in environments in which carbohydrates are a prominent chemical component (examples from above include cecal medium and mucin-rich broth). ES17's putative tail fiber protein (ES17-TFP) showed high similarity, based on a BLAST analysis (64% similar; E value, 0), to a tail fiber protein in another lytic podophage, the T7-like bacteriophage LM33_P1 (YP_009324518.1), which also targets ST131 strains. T7-like phage tail fibers have been shown to possess endo-sialidases that target surface sugars, such as capsule-forming polysaccharides. A BLAST analysis revealed that ES17-TFP contains a putative pectinesterase (E value, 7.45e203; 369 bp). This domain was only found in four other phages, myPSH1131, myPSH2311, vB_EcoS_Golestand, and LM33_P1, and of those, only myPSH1131 has it in the same tail fiber protein as ES17.

A structural analysis of modeled ES17-TFP showed a high similarity to a phage K5 lyase binding domain (E value=4e212). Phage K5 binds K5 capsular polysaccharide and acts as a K5 polysaccharide lyase. The K5 *E. coli* capsule is made of a repeating disaccharide that is identical to the precursor of heparin and heparan sulfate (HS), a linear polysaccharide present in glycosaminoglycans (heparan sulfate proteoglycans [HSPGs]). These proteoglycans are found on mammalian cells and in mucus. Also, mucins with similar structures to that of heparan sulfate/heparin (a-linked GlcNAc or N-acetyl-D-glucosamine) are present intestinally and found in porcine gastric mucin (PGM).

The inventors reasoned that ES17's enhanced activity might be due to an ability to bind mammalian polysaccharides found on glycoproteins, as other groups have found with different phage types. However, none of these groups had identified heparan sulfate proteoglycans, ubiquitous glycoproteins present at the basement membranes and surfaces of various cell types, as likely receptors for this interaction. Using this mechanism, phage could localize to its host, thereby explaining its enhanced activity in a mucin-rich environment. The inventors wished to extend these observations further and specifically pinpoint the exact type of carbohydrate that might mediate the hypothesized activity. To test this idea, the inventors cloned and purified ES17-TFP (Fig. S4E) and assessed the ability of purified ES17-TFP to bind to a glycan array containing more than; 860 unique glycan structures from porcine gastric mucin (PGM), glycosaminoglycans (GAGs) and a variety of synthetic and naturally sourced glycans generated by the Consortium for Functional Glycomics (CFG). No or very low relative fluorescent units (RFU), a proxy for binding, was observed for a wide array of mammalian glycans, including those purified from porcine gastric mucin. However, surprisingly, there was an increase of several orders of magnitude in RFU (RFU>2,000) observed for binding to the GAGs containing heparan sulfate (identification numbers [ID no.] 64 to 173) but not the structurally similar GAGs hyaluronic acid no. 1 to 20 or chondroitin sulfate no. 21 to 63 (Fig. S4Fiii). The finding that purified ES17-TFP binds human heparan sulfated proteoglycans provides a possible mechanism to explain why phage ES17 demonstrates enhanced activity in intestinal environments.

Figures 4A, 4B:
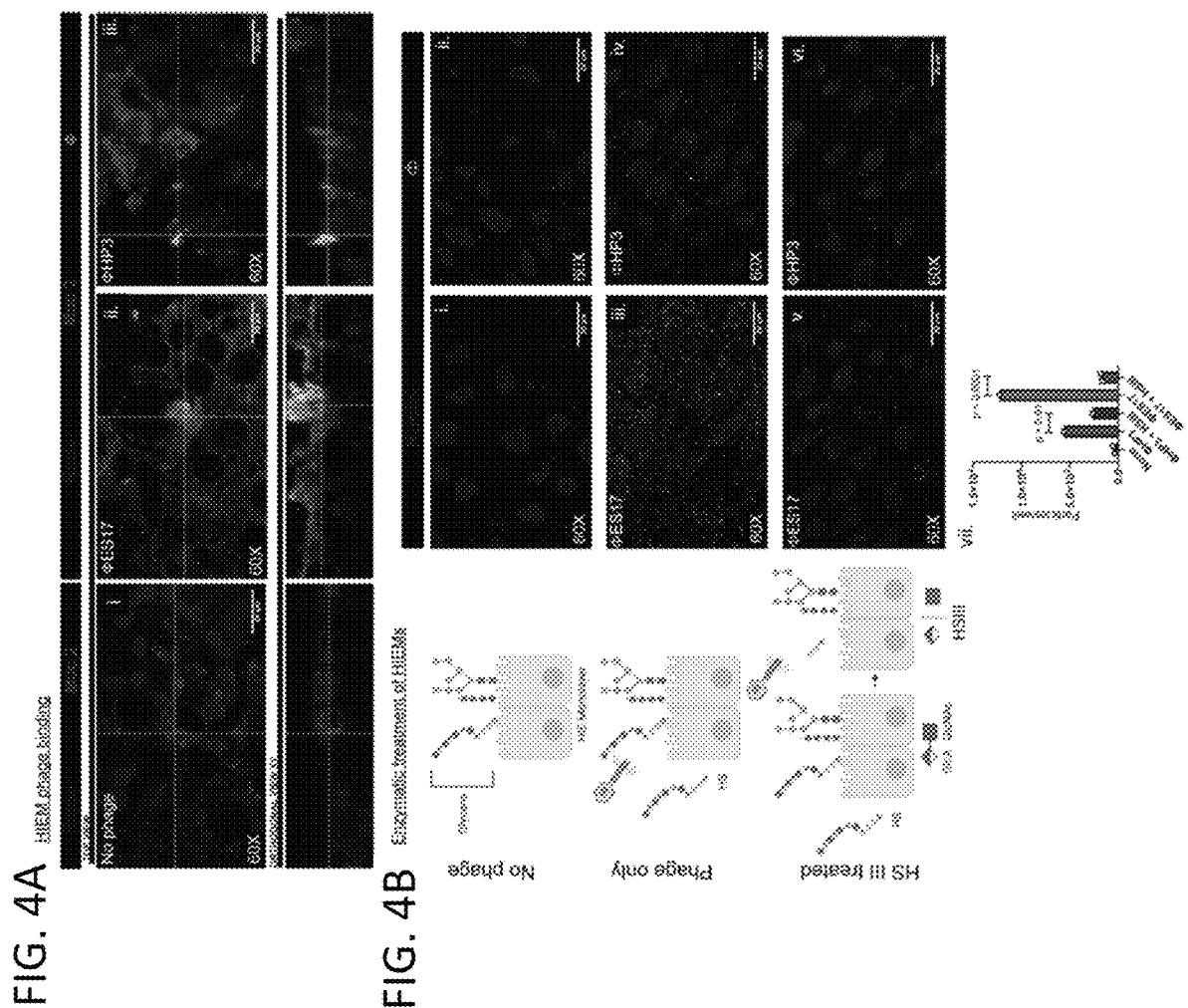
FIGS. 4A and 4B. ES17 binds to the surface of human intestinal enteroids (HIEMs). Differentiated HIEMs were incubated with phages ($10^8$ PFU/ml for 1 h) at 37° C., 5% $CO_2$, in a humidified incubator. Afterwards, HIEMs were washed, fixed in Clark's solution, stained, and imaged for phage (Alexa Fluor 488; green), intestinal cells (DAPI; blue), and Muc2 (Alexa Fluor 594; red). Image magnification, ×60. Orthogonal view XY shown below.

ES17 binds to the surface of human intestinal enteroids. Human intestinal enteroids (HIEs) are organotypic higher-order cultures that have become popular as surrogates to model the human intestine. They can be grown as 3-dimensional structures complete with a lumen and crypt/villus axis or as 2-dimensional monolayers that facilitate host-pathogen interactions. These cultures are also useful because they express a variety of glycans found in the human intestine, including mucins and proteoglycans. Human intestinal enteroid monolayers (HIEMs) were derived from colonic stem cells following differentiation for 5 days in high-Wnt medium. Phage ES17 or HP3 was added to confluent HIEMs for 1 h, extensively washed, and visualized by immunofluorescence microscopy using antibodies raised against each phage. Little to no detectable phage HP3 was observed on the HIEMs intestinal epithelial cell (IEC) surface, though antibodies generated robust signal and specificity toward the phage when HP3 was fixed on slides alone FIG. 4A). Phage ES17 (green) bound evenly to the IECs on the apical side, including areas where prominent Muc2 (red) localization was observed, but also on areas where there was no Muc2 staining (FIG. 4A). To determine whether phage ES17 bound to the IECs of HIEMs via heparan sulfate, the inventors pretreated the HIEMs with heparinase III to enzymatically remove HSPGs and then assessed phage binding. Indeed, HIEMs treated with heparinase significantly reduced the levels of bound ES17, both qualitatively and quantitatively (FIG. 4B) ($P<0.0001$). This finding is consistent with the purified tail fiber protein specifically binding to HSPGs. The localization of ES17 to both the mucus layer and to the IEC surface was by binding to HSPGs, which likely position the phage to be in the exact location needed to find its bacterial target in the intestinal microenvironment. To show that ES17 when bound to HIEMs could still infect bacteria, the inventors utilized the diarrhea-causing pathogen enteroaggregative *Escherichia coli* (EAEC), which adheres to HIEMs robustly in an aggregative mesh-like pattern unlike ExPEC. For this experiment, the inventors precoated HIEMs with phage ES17, washed them, as detailed above, and then infected them with EAEC strain 042. HIEMs were fixed and stained using a Giemsa-Wright stain to visualize cells and bacteria, as previously described. Infected HIEMs showed robust bacterial adhesion to cells with an aggregative phenotype (Fig. S4Hii, red arrows). Phage-coated HIEMs, however, showed significantly reduced EAEC on the surface of the organoid ($P=0.007$), demonstrating that bound ES17 is still infectious to this significant biofilm-forming pathogen.

Figure 5A:
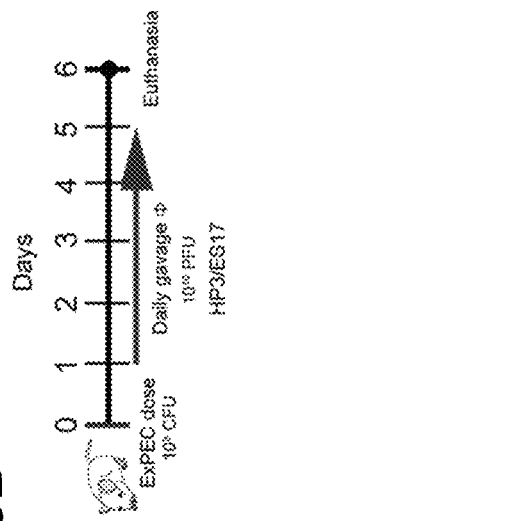
FIGS. 5A-5D.
Figure 5B:
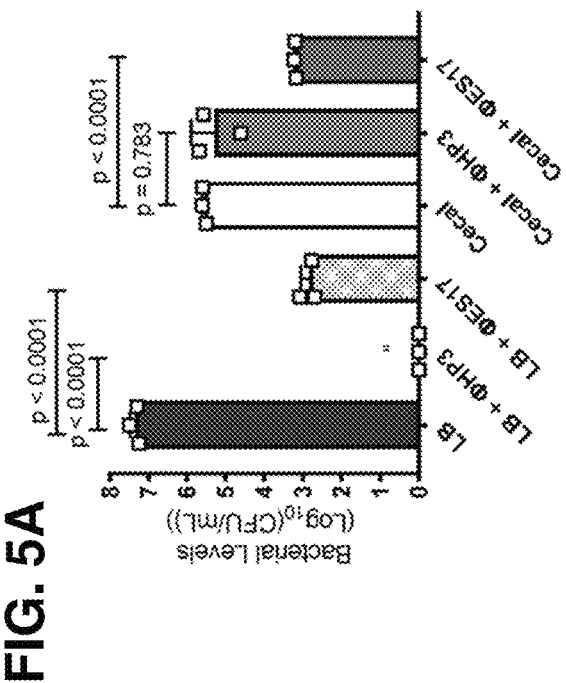
Figure 5C:
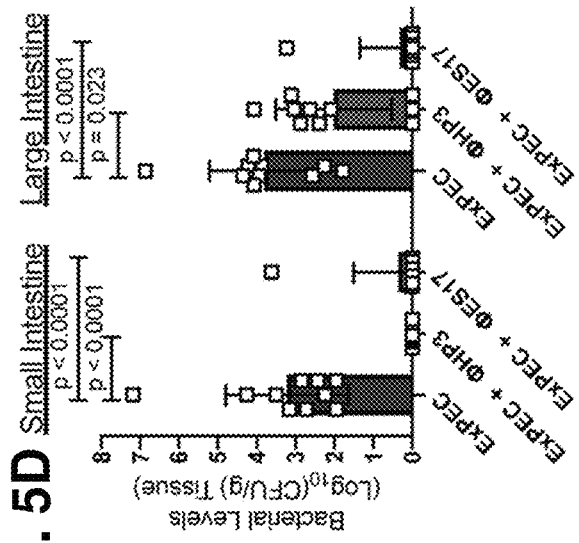
Figure 5D:
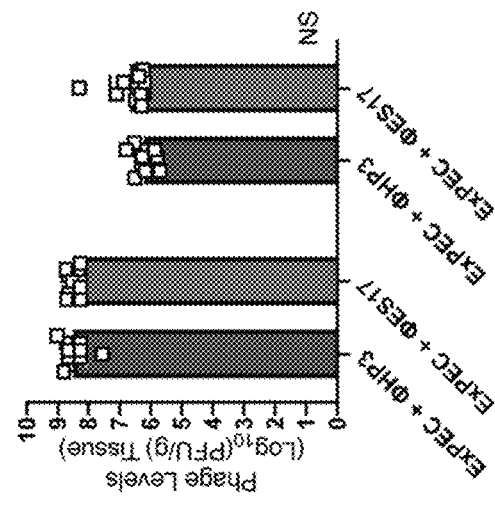
Figure 6:
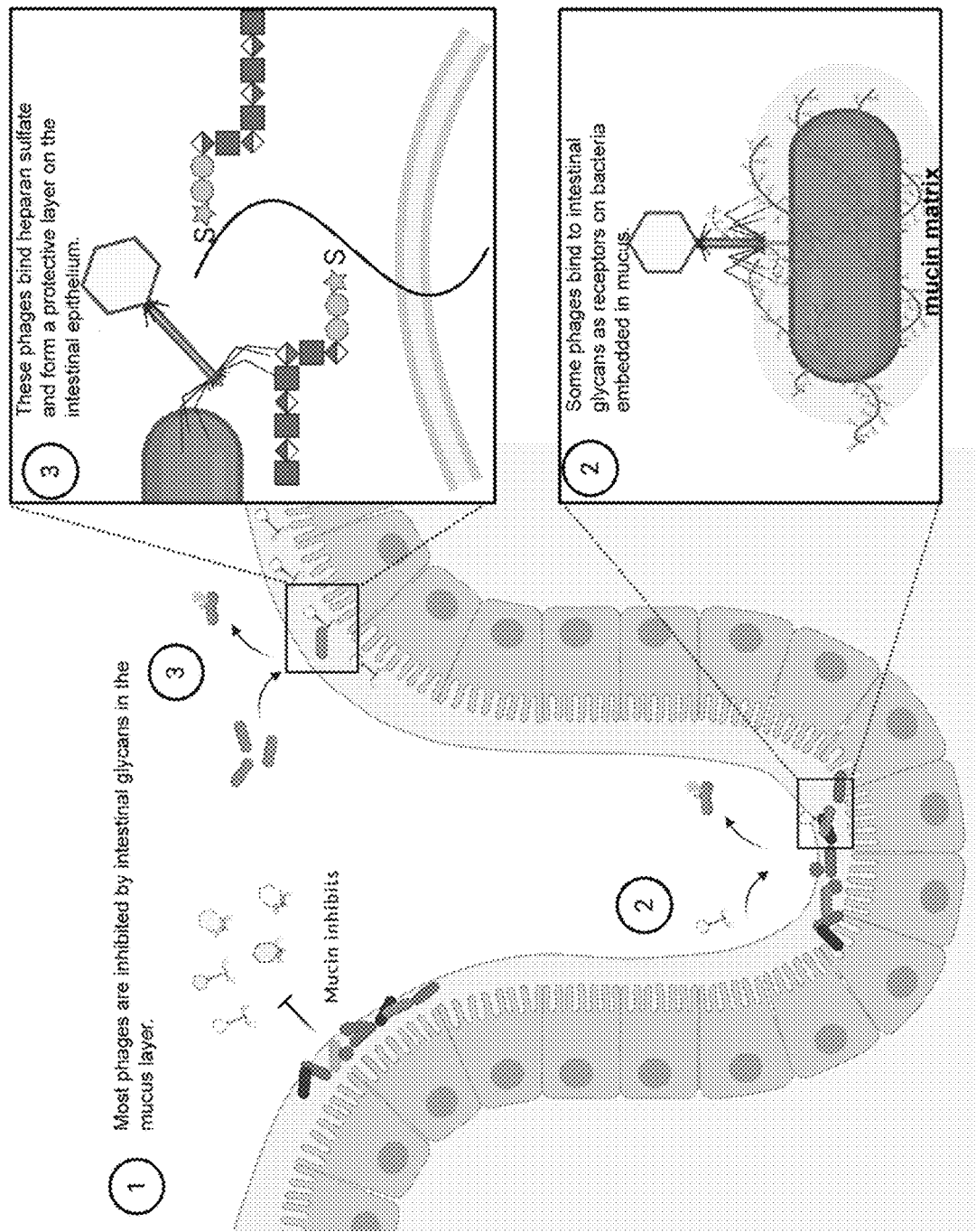
FIG. 6. Model showing (1) mucins from the intestinal mucus layer inhibit phage infection, (2) phage ES17 can bind to mucin and utilize other intestinal glycans as a receptor to infect and kill mucus-embedded bacteria, and (3) phages like ES17 can be utilized to coat the intestinal epithelium by binding heparan sulfate glycans to protect from invasive pathogen infection.

Phage ES17 kills ExPEC in the mammalian intestine. The finding that phage ES17 demonstrated enhanced lytic activity in the presence of mucins, was the best of several screened phages in a mock luminal environment rich in mucins, and binds the human organotypic culture IECs via HSPGs prompted an examination into whether this phage could overcome the intestine-induced inhibition of phage lytic activity toward colonized ExPEC that was observed for phage HP3. The inventors first tested if ES17 was effective in cecal medium. Indeed, phage ES17 showed a 2.5-log improvement in ExPEC removal in this environment compared to that of phage HP3 (FIG. 5A) ($P<0.0001$). There was no effect on the number of OTUs or the Shannon diversity index in this experiment, suggesting phage ES17 was highly selective at removing only the target ExPEC strain. The inventors next tested the effect of phage ES17 on ExPEC in a murine intestine. Animals were colonized with ExPEC as in FIG. 1A and treated with either phage ES17 or HP3 (FIG. 5B). The dose of phage was also increased from $10^9$ PFU to $10^{10}$ PFU to also evaluate if giving more phage would improve HP3's ability to reduce ExPEC, especially in more proximal segments, as the phage slowly moves through the alimentary canal. Examination of the small and large intestines on day 6 showed phage levels were high across all groups ($10^6$ to $10^8$ PFU/g intestinal tissue) (FIG. 5C). Animals treated with phage HP3 had no detectable CFU in small intestinal tissue (FIG. 5D) but had indistinguishable levels from those of the untreated controls in the cecum. This reduction and improved phage levels in the gut may be due to a log increase in daily phage dose given to animals ($10^{10}$ PFU) compared to that used for FIG. 1 ($10^9$ PFU). In contrast, every animal treated with phage ES17, except one, had no detectable levels of ExPEC in either the small or large intestine, suggesting that this lytic phage possesses a unique ability to target ExPEC in complex mucosal environments such as the large intestine.

Materials and Methods

Bacterial strains and phages. ExPEC ST131 isolate JJ1901 was used in all ExPEC infections, except for JJ2528.

Both isolates were previously obtained from Jim Johnson (University of Minnesota). Commensal *E. coli* ECN was isolated from a human fecal sample. Prior to infections, all strains were grown overnight at 37° C. from a single colony streaked on an LB agar plate.

Phages HP3, ES12, ES17, ES19, ES21, and ES26 were previously described and characterized. Phages 6914, 6915, and 6939 were recently isolated from sewage. All phages described were isolated by single plaque isolation from environmental sources as described previously.

Murine infections. Mixed ages (6 to 10 months) and sexes of BALB/c mice (Jackson Laboratories, Bar Harbor, ME) were used in mouse models of infection. Mice were kept in a specific-pathogen-free (SPF) environment at Baylor College of Medicine CCM (Center for Comparative Medicine) Taub facility. All methods performed on mice were approved and in accordance with relevant guidelines and regulations from the Guide for the Care and Use of Laboratory Animals (National Institutes of Health) and approved by Baylor College of Medicine's Institutional Animal Care and Use Committee (protocol AN-6372). For infections, mice were kept in a biohazard facility with sterile food and water. The mice were individually housed during colonization experiments, and bedding was replaced with autoclaved techboard liners for daily fecal collection. For colonization experiments, sample size was determined based on previous colonization experiments in mice. Mice received a $10^9$ CFU dose of ExPEC strain JJ1901 via oral gavage. Rodent health was monitored daily for indication of pain or disease. Bacterial colonization (fecal and intestinal) was determined after homogenization, selective plating for the chloramphenicol-resistant strain JJ1901 on LB agar plates containing chloramphenicol, and colony counting. A 6-day time course was established based on previous studies showing consistent colonization of ExPEC after 1 oral dose at $10^9$ CFU (87).

Purified phage in 3% (wt/vol) $NaHCO_3$ was administered either via gavage or in water with 5% (wt/vol) sucrose ad libitum. All groups received sucrose and $NaHCO_3$ in water for consistency. The antibiotic ampicillin (1 g/500 ml) was administered in water. Phage colonization was quantified after dilution of homogenates and serial plating on a double agar overlay assay of the ExPEC strain. Phage verification was determined by observation of plaque morphology compared to that of phage that was inoculated into mouse. Phage present in the native mouse microbiota did not plaque on the ExPEC strain.

Ex vivo cecal model. A modified cecal assay was used for experiments. Briefly, cecal contents from just-euthanized mice were pooled and homogenized in sterile 0.09% NaCl solution at a 1:5 dilution (milligrams per milliliter). The homogenate was centrifuged to remove large particulates (2,000×g for 30 s). The supernatant fluid was used for 4.5-h phage killing assays at a multiplicity of infection (MOI) of 10 at 37° C., shaking (255 rpm), as previously described. All cecal and mucin experiments were performed using independent bacterial cultures grown up from different colonies streaked on a plate. This was considered a biological replicate. For FS CM, cecal supernatant was centrifuged (6,000×g for 5 min.) and filtered through a 0.22-mm syringe filter. For HT CM, the supernatant was heated at 100° F. for 20 min in a hot water bath and then cooled to room temperature (RT) for infections. Insoluble CM and soluble CM (supernatant) were isolated post-high-speed centrifugation (9,000×g for 5 min) of CM. The insoluble pellet was resuspended in sterile 0.09% NaCl solution for infections (IN CM). For the mucin assays, porcine gastric mucin type II (PGM; Sigma-Aldrich) was used at various concentrations diluted in phosphate-buffered saline (PBS). The mucolytic drug N-acetyl cysteine (NAC; Sigma-Aldrich, 5 mg/ml) was diluted in PBS for demucolytic assays.

Mucin-coating adsorption and imaging. For the adsorption curves, assays were performed at an MOI of 1 using mid-log-phase cultures independently grown from different colonies on a plate (this was considered a biological replicate) as the inventors have done for previous publications to characterize phages ES17 and HP3. Prior to adsorption, PGM (0%, 0.5%, and 1.5% [wt/vol]) was added to the bacterial cultures for 10 min at RT with shaking (255 rpm). The cultures were centrifuged (6,000×g for 5 min) and gently washed with PBS. The adsorption rate constants (Ks) were determined from the natural log of the slope of the adsorption curve versus the bacterial concentration. Time points were taken every 5 min in order to accurately test simultaneously for the different conditions being assayed.

Mucin binding ELISA assay. Clear-walled Immulon 2 HB 96-well microtiter plates (Immunochemistry Technologies, no. 227) were used for the ELISAs. PGM (200 ml of 1 mg/ml) was added to a microtiter plate and incubated at 4° C. overnight. The next day, the mucin was removed and wells were washed twice with PBS. The phage was added to wells for 1 h and then washed three times in PBST (PBS with 0.1% Tween 20). The wells were blocked with bovine serum albumin (BSA) and then incubated with antibodies for the phage overnight at 4° C. Following washing steps, a horseradish peroxidase (HRP)-conjugated antibody was added for 1 h. To assess phage binding, 3,39,5,59-tetramethylbenzidine (TMB) solution was added until the wells turned light blue, and then a stop solution (2 M H2SO4) was added. The absorbance was read at 450 nm. Each well was considered a biological replicate for this experiment.

HIEM infection and imaging. Human enteroid monolayers (HIEMs) were differentiated for 5 days (0.90% confluence) as described previously (54). For experiments, each well containing a HIEM was considered a biological replicate. HIEMs were incubated with phage at 108 PFU/ml in culture differentiation medium for 1 h at 37° C. in the presence of 5% $CO_2$ in a humidified incubator and then washed in PBS. The HIEMs were fixed in Clark's solution for 10 min to preserve the mucus layer. The HIEMs were permeabilized and blocked with 5% BSA in 0.1% Triton X-100 in PBS for 30 min at RT. Mucus was detected using antibodies to Muc2 (1:200) (Abcam), and nuclei were stained with 49,69-diamidino-2-phenylindole (DAPI) (300 nM) for 5 min at RT. Antibodies against phages HP3 and ES17 were generated from whole-virus (phage) injection into rabbits performed by Pacific Immunology. A 13-week antibody production protocol consisted of 4 immunizations and antiserum collection.

To selectively removed HSPG from GAG chains, enteroid cultures were pretreated with heparinase III (Sigma, 2 U/ml) for 2 h, as described previously (89), followed by the addition of phage. Images were captured using a Zeiss LSM 510 confocal microscope. Represented images were adjusted equally for brightness and contrast using FIJI software version 2.0.0. The images were adjusted equally for brightness and contrast. Particle analysis was used to determine the number of particles per well.

Statistics. Statistical analysis was performed using PRISM 8 software. Microbiome 16S data were analyzed using ATIMA (Agile Toolkit for Incisive Microbial Analyses). For figures with log-transformed data and groups of 0.2, significance was determined using a one-way analysis of variance (ANOVA) (FIGS. 1-5) or two-way ANOVA when necessary (FIG. 3E). For multiple-comparison analysis, the secondary test, Tukey, was used. For nontransformed data, a normality test (Shapiro-Wilk) was performed to determine normality before a one-way ANOVA analysis was performed. Significance was determined to be a P value of less than or equal to 0.05. Unless otherwise stated, all graphs show the means and standard deviations.

Example 2—Antiviral Resistance and Phage Counter Adaptation to Antibiotic-Resistant Extraintestinal Pathogenic *Escherichia coli*

Figure 7A:
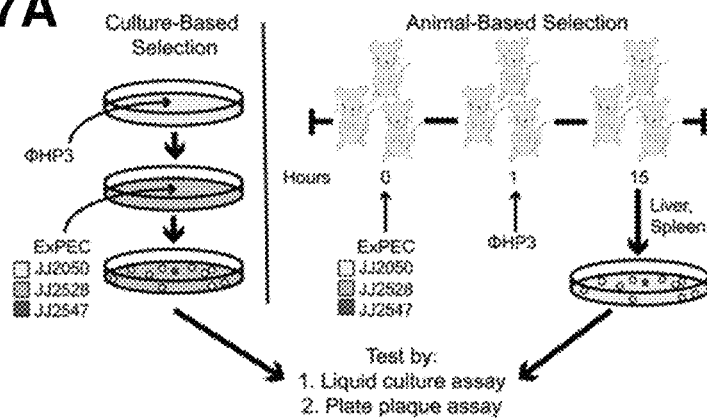
FIGS. 7A and 7B. Three clinical ExPEC isolates—JJ2050, JJ2528, and JJ2547—were used to develop resisters against ϕHP3.

Selection of phage-resistant bacterial isolates. φHP3 is an extensively characterized, lytic phage that is an effective therapeutic in a murine sepsis model. It has also, with single-use INDs, been successfully used in two patients with *E. coli* infections. Three clinically-derived ExPEC strains, JJ2050, JJ2528, and JJ2547, were selected as MDR pathogens capable of causing illness in this model. These strains are all of sequence type (ST)131 and were isolated from different patients. When treating mice for ExPEC-derived sepsis, the inventors found that although phage reduced bacterial burden in most animals, some subjects maintained relatively high bacterial levels. The inventors hypothesized that, in these cases, phage-resistant isolates ("resisters") had arisen during treatment. To test this hypothesis, the inventors isolated phage-resisters by challenging them with φHP3 using two different methods (FIG. 7A). The first method, culture-based selection, consisted of streaking an overnight bacterial culture on an LB plate coated with phage. The second, animal-based selection, used the inventors' murine sepsis model to recover resisters from phage-treated animals. Briefly, mice were given an intraperitoneal (IP) injection of each ST131 strain followed by IP injection of phage one hour later. Bacterial isolates were then recovered from the livers and spleens of the euthanized mice the next day.

Figure 7B:
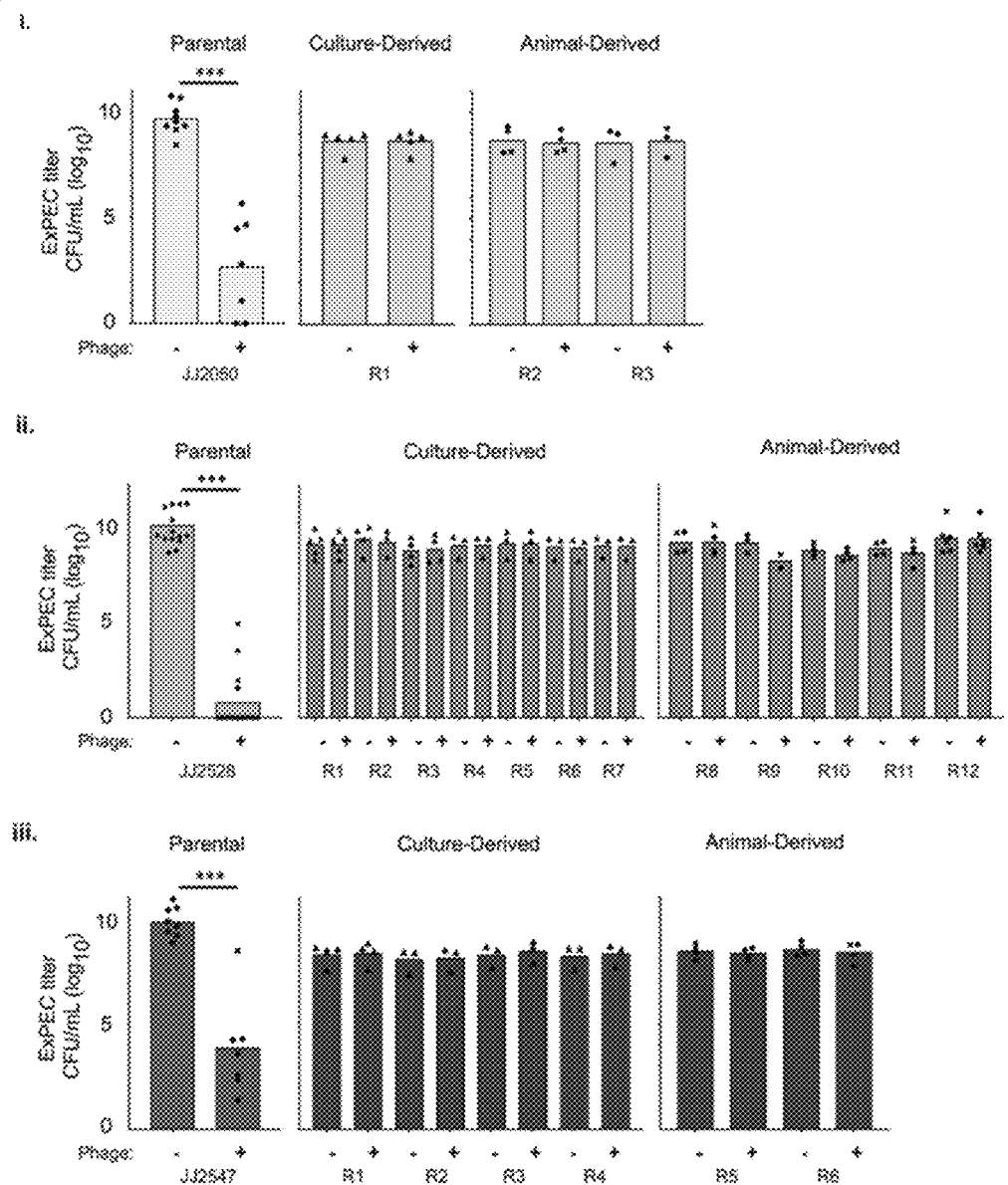

Isolates from both strategies were tested for phage-resistance by two methods: co-incubation in liquid culture (1), and phage spot assay (2). For the co-incubation assay, isolates were grown for 4.5 hours in LB with or without phage. The three parental ST131 strains were readily killed by φHP3 (FIG. 7B). Isolates that survived the co-incubation selection, however, were refractory to any killing by phage (FIG. 7B). Further, parental isolates yielded a high phage titer by spot assay, but the resisters produced no observable phage progeny. These findings indicate the isolates have acquired full resistance to φHP3. Between the two isolation strategies, a total of 21 independent resisters were isolated, summarized in FIG. 15. The majority of resisters had smaller colonies compared to their WT progenitors.

Figure 8:
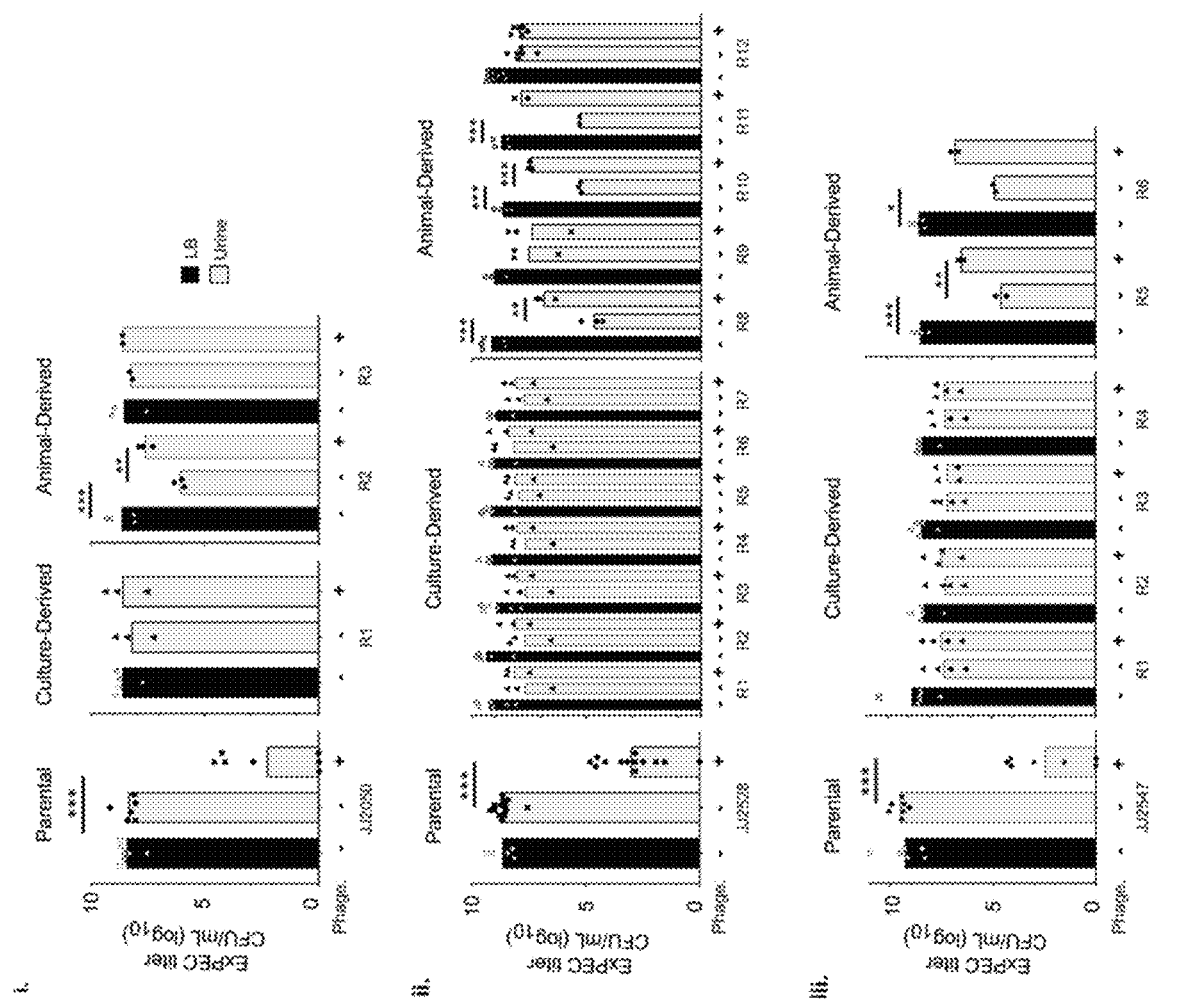
FIG. 8. Isolate titers were determined in liquid culture after 4.5 h of incubation in LB (black) or human urine (yellow), with or without f HP3. Each panel is grouped by parental isolate: JJ2050 (i), JJ2528 (ii), and JJ2547 (iii). P values were determined by Student t test or Mann-Whitney test, where necessary. *, P<0.05; , P<0.01; *, P<0.01. Each data point represents the average of three parallel technical replicates.

Resistance is associated with loss of fitness in host microenvironments. Resistance to phage may accompany a loss of fitness under certain environmental contexts; of particular interest are findings of loss of virulence in the hosts. Such a loss has been observed for bacterial pathogens of fish and moths, has been modeled in *A. baumannii*, and has been inferred with *V. cholera* in humans. To assess virulence in their isolated resisters, the inventors tested their growth ability in mediums which simulated the host microenvironment. Since ExPEC strains cause UTIs and bacteremia, human urine and blood were used here. In urine, most of the resisters demonstrated comparable growth relative to Luria broth (LB); these same resisters likewise had comparable growth to their wild-type (WT) progenitors (FIG. 8). Interestingly, all resisters with attenuated growth in urine (six of nine) were isolated from the murine model. Further, φHP3 retained effectiveness against WT isolates, but was ineffective against resisters. Strikingly, and for reasons currently unknown, the six attenuated animal-derived resisters showed enhanced growth in the presence of φHP3 (FIG. 8; yellow bars, +). This growth enhancement was not replicated by the phage buffer alone (data not shown). Overall, this data suggested most of the animal-derived resisters, though none of the culture-derived ones, had undergone a fitness trade off that compromises their ability to grow well in human urine.

To assess if the ExPEC resisters demonstrated any fitness losses in blood, isolates were first assessed for growth and survival in unaltered human whole blood (WB; FIG. 9A). Whereas WT JJ2547 thrived in WB after 24 hours, the resistor strains, regardless of isolation method, had significant drop in viability (FIG. 9B). The inventors hypothesized the resisters' fitness loss was due to the complement system in serum, a potent antibacterial mechanism. To disable complement, the inventors heat treated the plasma fraction and recombined it with the blood cell fraction, a mixture termed heat-inactivated plasma blood (HIPB; FIG. 9A). The resistor strains remained substantially attenuated, with an average 7-log drop in viability (FIG. 9B). The inventors next hypothesized a loss in nutrient uptake may cause the resisters' loss of fitness. To replicate the nutritional environment of blood in a more readily accessible form, the inventors used a defined medium called blood serum mimic (BSM). Resister survival was improved when HIPB was mixed with BSM 1:1 (HIPB/BSM; FIG. 9B); interestingly, however, resister survival was poor when the blood cell fraction was suspended in BSM (BSM+; FIG. 9B). When grown in BSM alone, resister growth was comparable to the parental strain (FIG. 9B). This suggested something in both the blood cell and plasma fractions was unfavorable for resister survival. The other WT and resister strains reproduced this general trend. Interestingly, parental JJ2528 demonstrated a marked deficit in growth in blood; this was somewhat surprising due to the strain's high virulence in a murine model of bacteremia. Overall, this data suggested that in order for the resisters to overcome phage infection, they have acquired a dramatic loss of fitness in human blood that is not driven by complement or nutrient uptake.

Figure 10A:
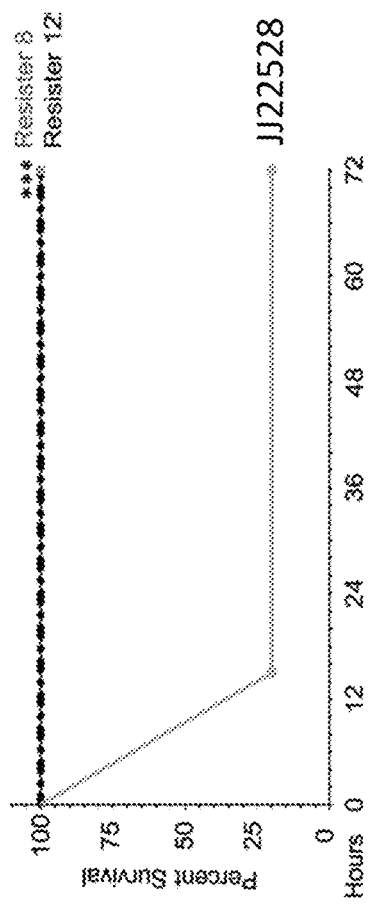
FIGS. 10A-10D. Two representative resisters, JJ2528-8 ("Resister 8", dark gray, ompA truncated) and JJ2528-12 ("Resister 12", black, waaC truncated), and their parental isolate (light gray) were tested for virulence in the murine sepsis model.
Figure 10C:
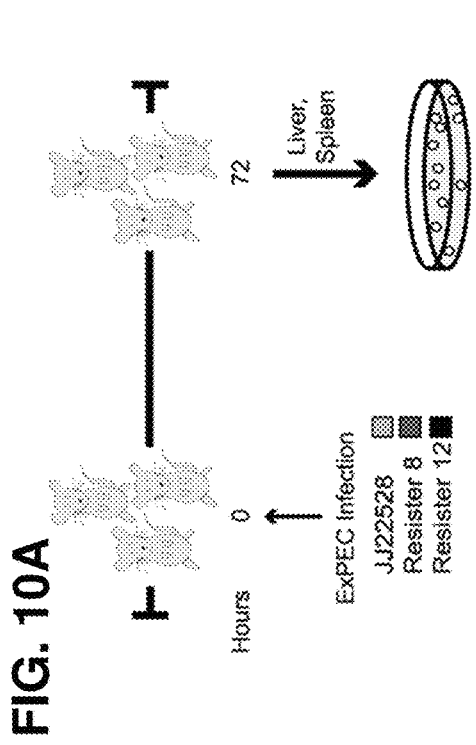
Figure 10B:
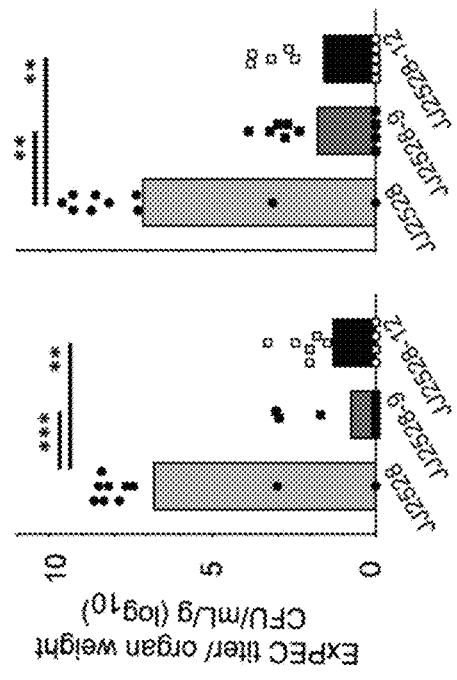
Figure 10D:
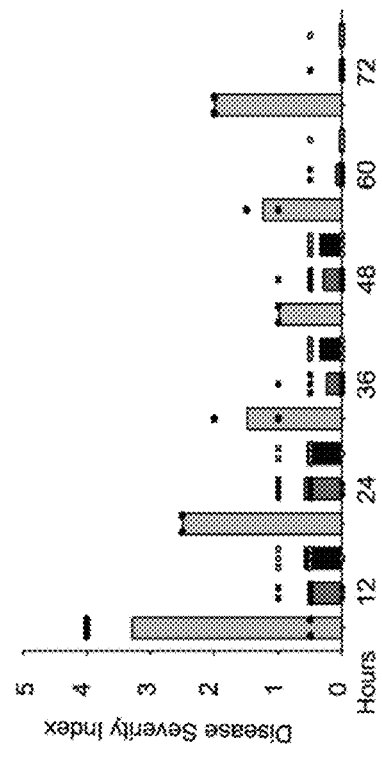

Phage resistors are attenuated during systemic infection. The resisters' loss of fitness in human blood and, in several of the animal-derived resisters, urine prompted us to assess resister pathogenicity in a murine model of bacteremia (FIG. 10A). For this study, the inventors selected two representative isolates from their resister list (both animal-derived, based on colony morphology) and compared their virulence and bacterial levels to the parental strain after infection. Surprisingly, every animal infected with the resister strains survived for the duration of the experiment, compared to 20% survival with the parental strain (FIG. 10B). Further, animals infected with the resisters had lower disease severity scores at every time point of the study (FIG. 10C) and displayed, on average, an approximately 4.5 log reduction in organ bacterial burden (FIG. 10D). This data suggested that these resisters sustained a loss of fitness in a murine model of systemic infection, and was consistent with the observed loss of survival in simulated host microenvironments.

Mechanism of resistance relates to mutations in bacterial surface components. To understand the mechanism driving ExPEC resistance to φHP3, as well as give insight into the reasons for reduced virulence, whole genome sequencing was performed on all 21 resisters, followed by an alignment of the assembled genomes to the parental strains (FIG. 11A). Remarkably, 15 of 21 resisters, regardless of the parental strain or isolation strategy, harbored truncations of varying degree in a single operon: the waa (or rfa) system, which is responsible for the assembly of lipopolysaccharide (LPS). Of these 15, one gene, waaC, was truncated or missing in every mutant. WaaC is responsible for the attachment of the second saccharide (L-glycero-D-manno-heptulose, LD-Hep) to the first (1-deoxy-D-manno-oct-2-ulsonic acid, KDO), forming the inner core of LPS (FIG. 11B). This mutation likely results in loss of most of the inner and outer core as well as 0-antigen. Four of the remaining six resisters had truncations in hldE, responsible for two steps in the synthesis of LD-Hep (FIG. 10B). This mutation, phenotypically, is likely to produce an identical, truncated LPS molecule to the waaC truncation. This is consistent with the findings of Mutalik et al. who found a tendency for E. coli strains to develop mutations in the waa operon, or in the construction of LD-Hep when developing resistance to coliphages. This was similarly found for isolates of Pseudomonas aeruginosa. This pointed to a conserved mechanism of resistance for ST131 E. coli to φHP3 via the truncation of surface LPS.

Of the final two resisters, one had a truncation in ompA, which expresses outer membrane protein (OMP) A, which forms pores in the bacterial outer membrane to import nutrients. Both of the two remaining mutant strains had a single nucleotide polymorphism (SNP) shortly downstream from the gene of ompA, which the inventors hypothesize to be a rho-independent terminator region; this modification may affect transcript polyadenylation, thus decreasing transcript stability. These two resisters also had truncations in the wzy O-antigen polymerase gene, though this may be unrelated to phage resistance in this case. A summary of the mutations in each of the 21 resisters, and a structural representation of their location in the LPS molecule, is shown in FIG. 11C. These findings suggested that the ST131 resister isolates attained resistance to φHP3 through loss of either LPS (19/21 cases) or OmpA (2/21 cases). Since both of these components are located on the surface of E. coli, the data suggested these two features may constitute primary and/or secondary receptors for phage HP3. An alternative hypothesis is that the loss of these genes disrupts E. coli's surface integrity in a way that prevents proper attachment or adsorption of HP3.

Directed evolution guides the emergence of anti-resister phages. A somewhat unexpected finding from these studies was the frequency by which ST131 resisters arose in vitro and during infection, and their convergence in all 21 independent cases towards one or two key mutations in LPS or OmpA. Though there was clear reduction in virulence in the two mutants tested by murine sepsis model (one mutant in LPS and one in OmpA, FIGS. 10A-10D), it is worth noting that they were isolated during phage challenge of parental strains in infected animals, and were at high enough levels to be isolated (FIG. 13). The consistency of these findings suggested that a highly effective, "two-hit" phage cocktail could be developed; specifically formulated with phages to drive development of resisters that are less virulent in their host, and phages (developed to "predict" resistance mechanisms) which target those resisters.

Figure 12A:
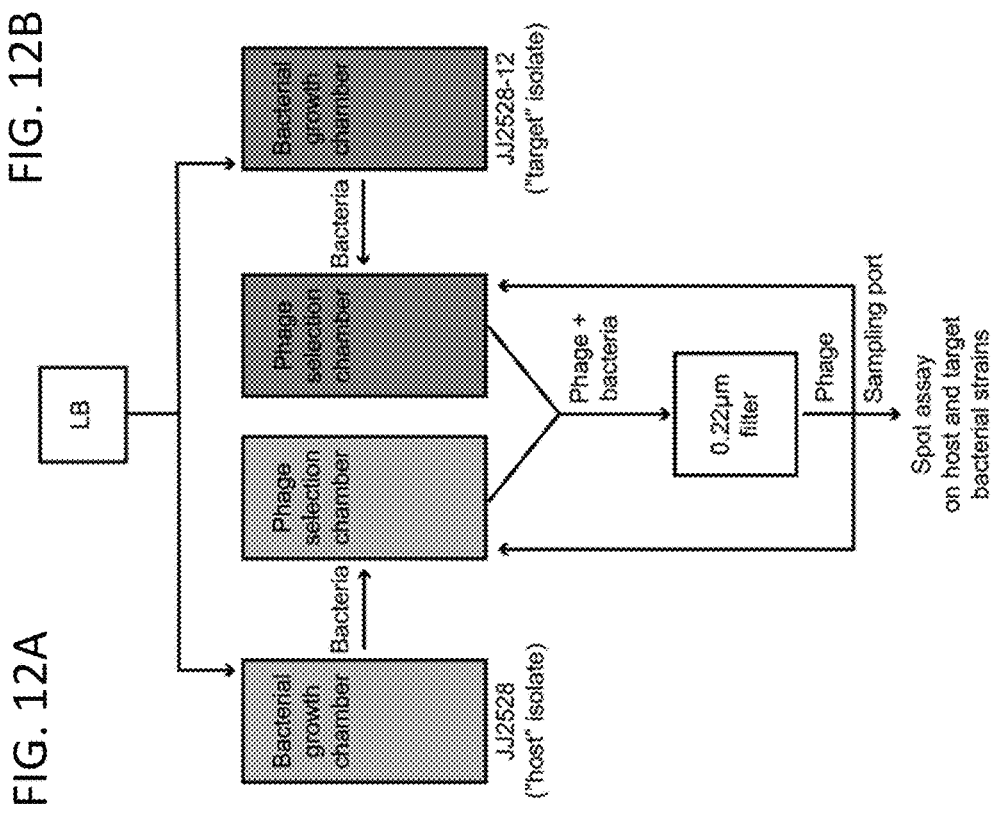
FIGS. 12A and 12B.

To test this, the inventors first screened two well-characterized phages (φES17 and φEC1) for their ability kill the ST131 resister strains. Surprisingly, although these phages effectively kill all three parental strains, every resister was refractory to killing by these phages (FIG. 16). Since these phages are distinct from HP3 (genetically and morphologically), it may suggest there are common mechanisms of resistance in ST131 to coliphages. A screen of sewage samples for plaque formation on resister lawns also did not reveal any candidate lytic phages against the resisters. The inventors hypothesized the original phage, φHP3, could undergo adaptation in order to reinfect the resisters. To test this, the inventors generated an automated bacteria-phage bioreactor that continuously cycled fresh phage grown on its original bacterial host (parental strains) into a chamber that contains the target bacterium (resistant isolates) (FIG. 12A).

Figure 12B:
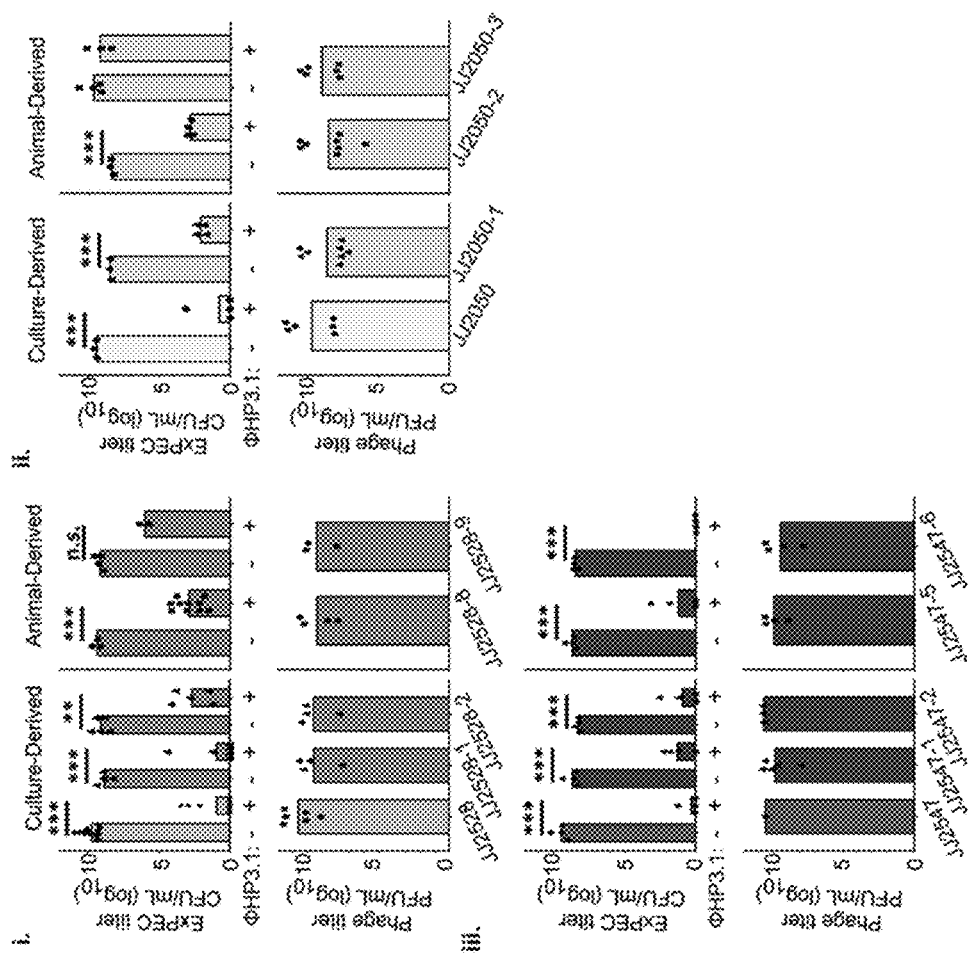

To determine if this approach would yield a phage derivative capable of infecting the resisters, parental JJ2528 was co-cultured with phage φHP3, and phage progeny then cycled to the chamber containing the resister isolate JJ2528-12. Samples were taken from the chamber at 5, 21, 24, and 37 hours and tested by spot assay on both the host and target isolates. Unexpectedly, a sample taken at five hours yielded noticeable clearing on JJ2528-12, as well as the parental host, which increased with time. A plaque from these was isolated, expanded in its new host, and purified. The new phage, designated φHP3.1, showed bacterial killing in the liquid culture assay (and plaque formation in the spot assay) for most of the resisters (either animal- or culture-derived) of JJ2528 (FIG. 12B). In addition, φHP3.1 was able to infect not just the target resister used in the directed evolution experiment, but every LPS-truncated resister as well, while retaining effectiveness against all three parental isolates (FIG. 12B; FIG. 16). Interestingly, the two ompA resisters retained partial (SNP only, JJ2528-9) or full (SNP and truncation, JJ2050-3) immunity to the evolved phage.

To verify φHP3.1 was a derivative of φHP3, and to identify genetic changes associated with its broad activity against the resisters, the inventors subjected the purified phage to whole genome sequencing. Bioinformatic comparison of φHP3.1 to φHP3 indicated just two SNPs along the length of all 176,000 base pairs. The first of these changes, a LysTyr464 to ArgHis464, was located in the gene encoding the spike protein (FIG. 13A), potentially at its binding site with the bacterial host (FIG. 13B). The second SNP coded a missense mutation in the long tail fiber gene, Gln9 to Arg9. Both instances result in substitution of residues with non-polar side groups to ones with positive charges at the extreme tip of the spike gene. This suggests that phage φHP3.1 may be able to re-infect ST131 resisters trough compensatory mutations which enhance the phage's interaction with the host surface, possibly via electrostatic charge modifications that promote binding or adsorption.

Figure 14A:
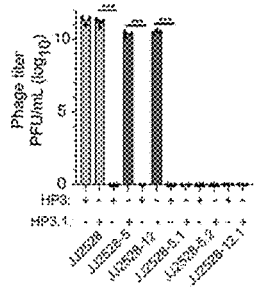
FIGS. 14A-14C. Two ϕHP3 resisters, JJ2528-5 and JJ2528-12, were used to select ϕHP3.1-resistant isolates using the culture-derived method depicted in FIG. 7B.
Figure 14B:
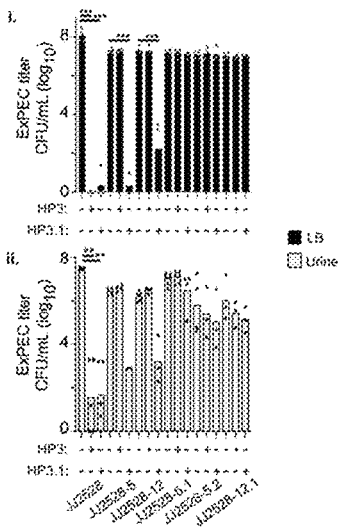
Figure 14C:
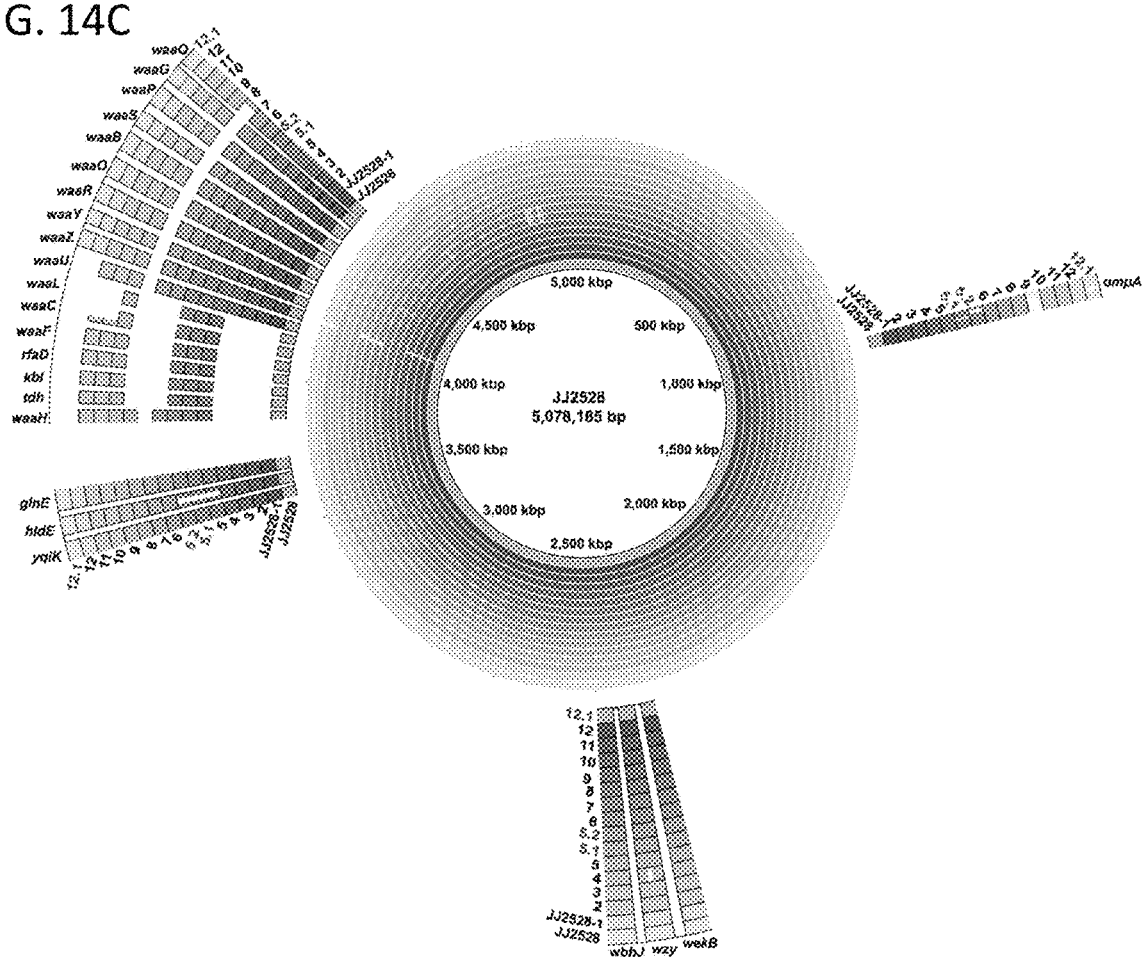

Compensatory ST131 ExPEC mutations allow resister re-resistance to the evolved φHP3.1. Phage and their bacterial hosts engage in cycles of coevolution. The inventors wondered if the resister strains had the ability to once again evolve resistance against the new phage, φHP3.1. Using the culture-derived selection method shown in FIG. 7A, the inventors identified three ExPEC isolates that grew in the presence of φHP3.1: two from JJ2528-5 (JJ2528-5.1 and JJ2528-5.2), and one from JJ2528-12 (JJ2528-12.1). It was not possible to derive animal-derived resisters to HP3.1 due to their poor virulence in infection challenge models (FIG. 10). The new resister strains were refractory to killing in both phage spot assays (FIG. 14A) and liquid culture assays (FIG. 14B), confirming their resistance. These secondary resisters maintained their ability to grow in human urine (FIG. 14B). Whole genome sequencing of these resisters showed they maintained their parental truncations in hldE and waaC, respectively. Rather excitingly, and consistent with the above results, all three acquired new truncations in their ompA genes, similar to JJ2025-3 (FIG. 14C). This finding strongly suggests that OmpA is a partial receptor for phage φHP3 and a primary receptor for its evolved progeny, φHP3.1. That the ompA modification was observed in two of the 21 original resisters may reflect phage-ST131 evolution dynamics occurring at this second step during the first screen, possibly due to added selective pressure from the murine system.

Example 3—Activity of Phage Cocktail Comprising HP3, HP3.1, and HP3.2

Figure 17A:
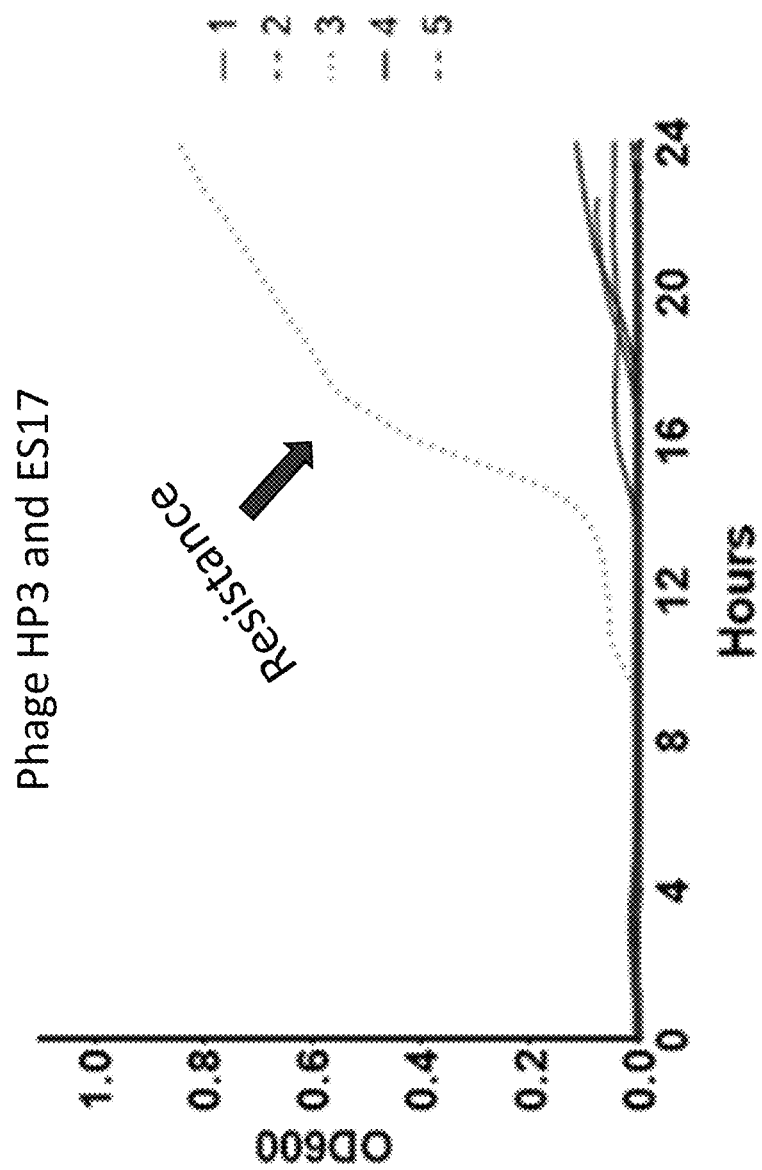
FIGS. 17A and 17B.
Figure 17B:
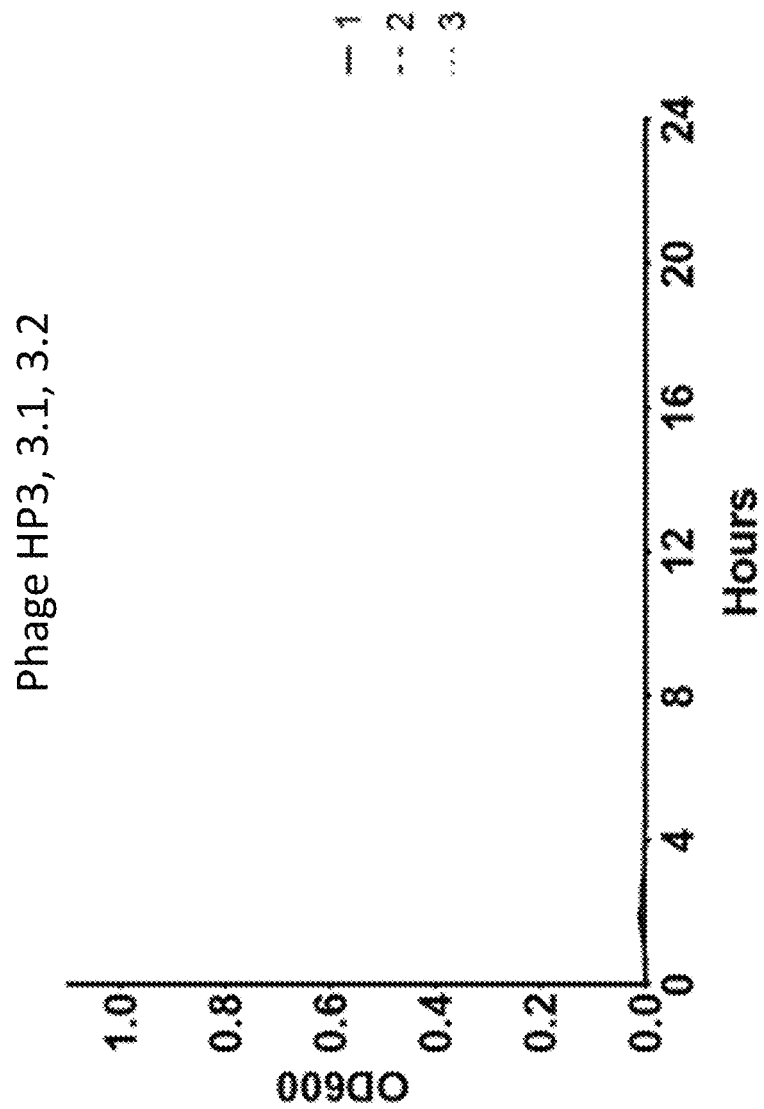

E. coli were grown with a cocktail comprising phage ES17 and HP3. As shown in FIG. 17A, the phage cocktail initially suppressed the bacterial growth but was overcome by resistant strains (shown by an increase in OD600 in certain experiments within 24 hours after treatment). E. coli were then grown with a cocktail comprising phage HP3, HP3.1, and HP3.2. As shown in FIG. 17B, outgrowth of E. coli was not observed under these conditions past 8 hours up to 24 hours after treatment.

Figure 18:
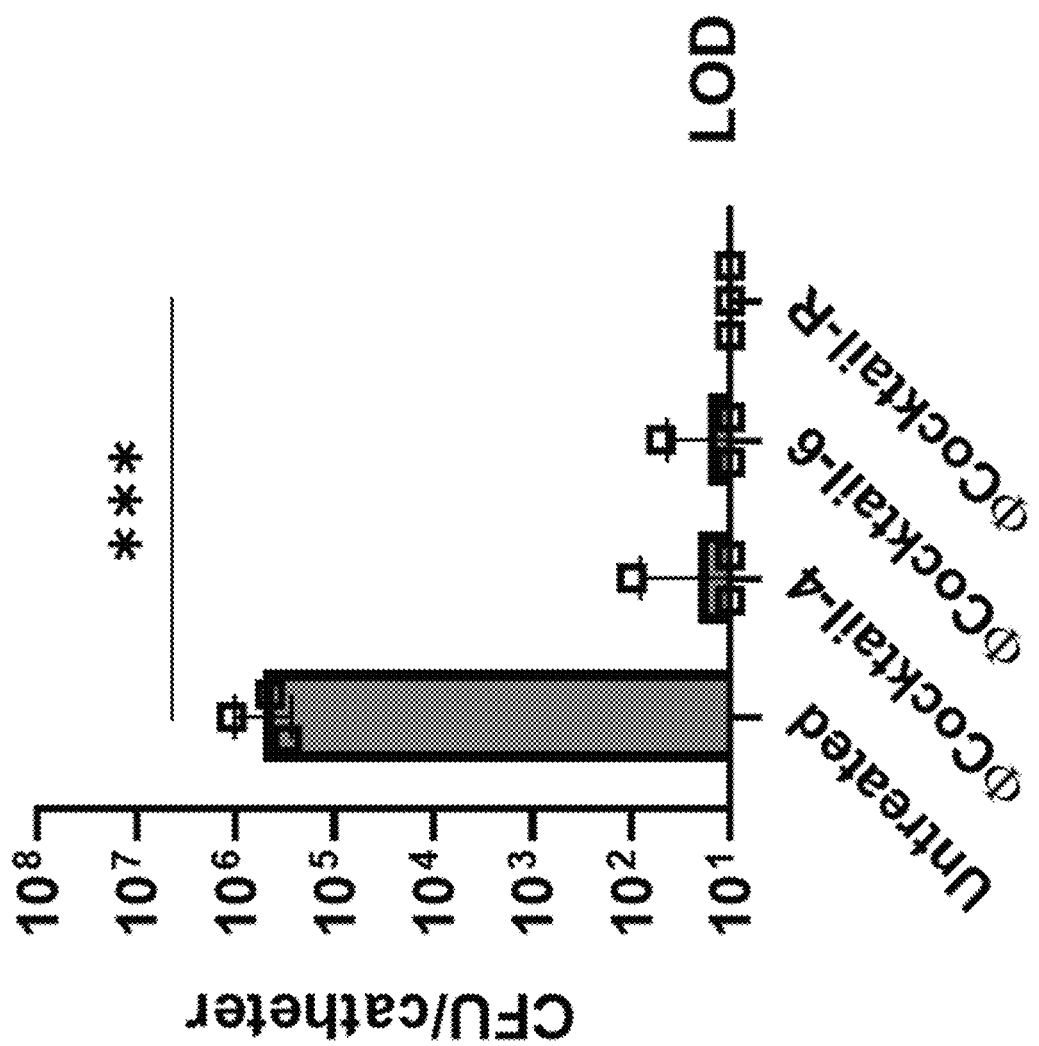
FIG. 18 shows $E.\ coli$ colony forming units (CFU) from growth on human catheters, either untreated or treated with the phage cocktails shown.
Figure 19:
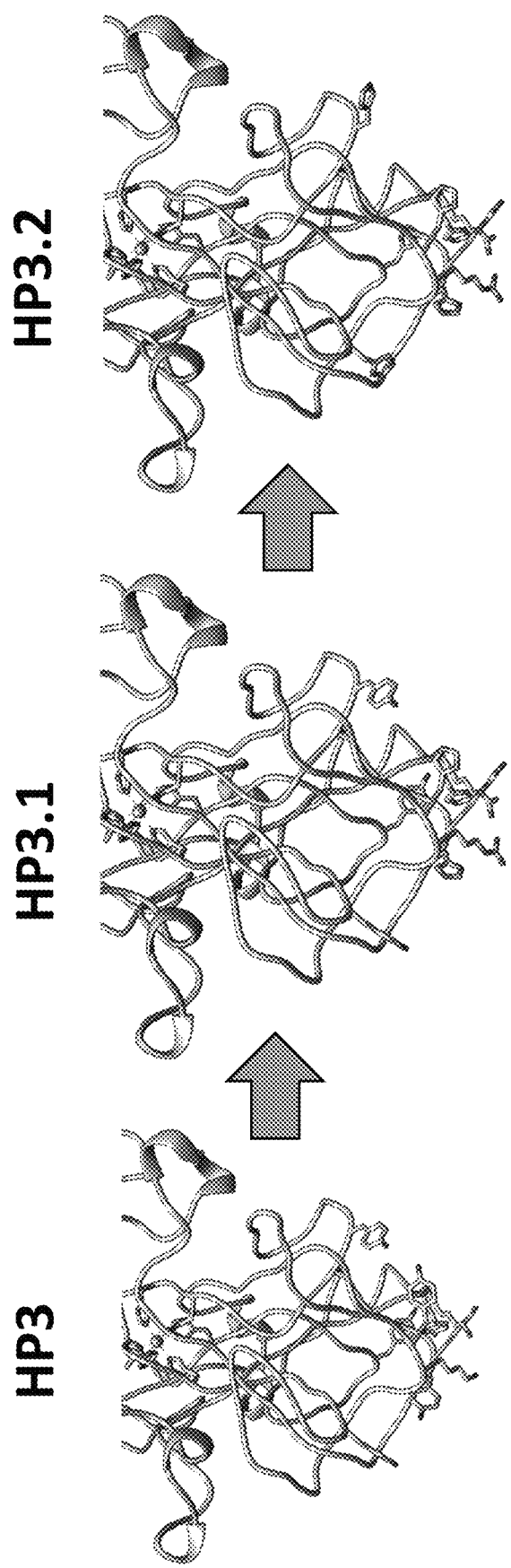
FIG. 19 shows a molecular model of the tail fiber gene protein product from ϕHP3, ϕHP3.1, and ϕHP3.2. ϕHP3.1 and ϕHP3.2 each contain a mutation in the tail giber gene, the protein product of which is believed to interact with its $E.\ coli$ receptor.

Next, E. coli biofilms were formed on human catheters, followed by treatment of the catheters with a cocktail comprising ES17, HP3, HP3.1, and HP3.2 (Cocktail-R). As shown in FIG. 18, treatment with ϕCocktail-R disrupted biofilm formation and prevented resistance after 24 hours of treatment.

Example 4—Activity of Phage Cocktail Comprising HP3, HP3.1, and ES17

Mice (Swiss Webster; female; 6-8 weeks old) were infected with $10^8$ CFU of E. coli clinical isolate JJ2528 via IP (intraperitoneal) route. One hour later mice were injected (IP) with purified phage (HP3) or a cocktail of phages (HP3, HP3.1 and ES17) at a dose of $10^9$ PFU/phage. After an overnight infection mice were euthanized and major organs homogenized and plated for remaining CFU.

Figure 20:
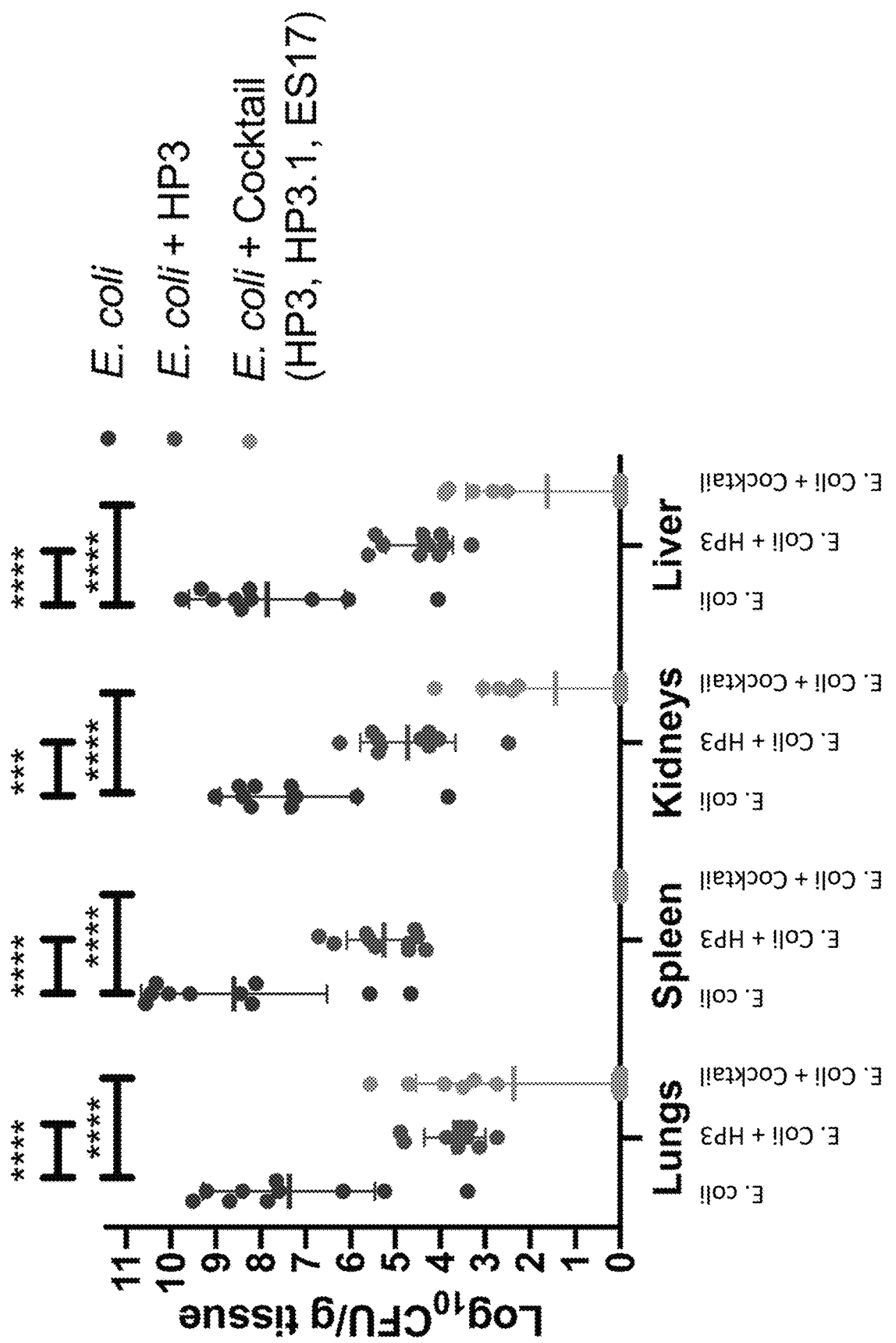
FIG. 20 shows results from analysis of mice infected with $E.\ coli$ and treated with HP3 phage or a phage cocktail comprising HP3, HP3.1, and ES17. Standard deviation and mean pictured. N=10 for each group. Significance was determined using two-way ANOVA *p<0.001, **P<0.0001.

As shown in FIG. 20, mice treated with phage cocktail comprising HP3, HP3.1, and ES17 had significantly reduced E. coli CFU in the lungs, spleen, kidneys, and liver.

Example 5—Bacteremia Cocktail Efficacy

Figure 21:
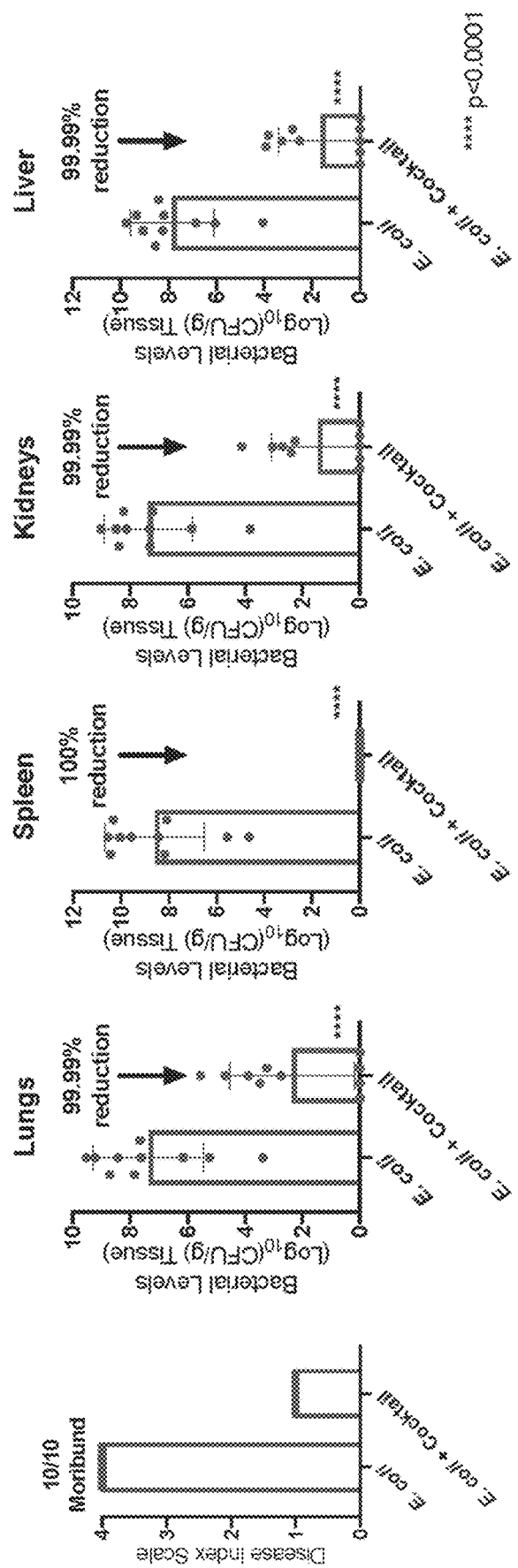
FIG. 21 shows efficacy of phage cocktail HP3, HP3.1, and ES17 in reducing bacterial levels in mice infected with pathogenic $E.\ coli$. Mice were infected with $1 \times 10^8$ colony forming units of ExPEC strain 2050, a pathogenic pandemic ST131 $E.\ coli$. After 24 hrs, mice were either treated or not with $1 \times 10^8$ PFU (total) SC of phages 3, 3.1, and ES17. Bacterial levels were recorded 24 hrs later by necropsy and plating of organs to determine bacterial levels.

The subject matter was evaluated for cocktail performance relative to the prototype phage HP3. The first study (FIG. 20) assessed the effect of a cocktail of three phages (3, the anti-resistor phage 3.1, and the biofilm and mucosal binding phage ES17) at reducing bacterial levels in a murine model of bacteremia versus the parent and prototype phage HP3. The murine host was infected with ExPEC strain 2050 at 1×10^8 and 24 hrs later the cocktail was administered SC. The cocktail was superior to the HP3 only phage group at reducing bacterial levels in all four organs assessed. In FIG. 21, the disease index was assessed of the cocktail relative to no treatment, as above, showing substantial reduction in disease in cocktail treated animals. This extended to bacterial levels in organs.

All of the methods disclosed and claimed herein can be made and executed without undue experimentation in light of the present disclosure. While the compositions and methods of this invention have been described in terms of certain embodiments, it will be apparent to those of skill in the art that variations may be applied to the methods and in the steps or in the sequence of steps of the method described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

REFERENCES

The following references, to the extent that they provide exemplary procedural or other details supplementary to those set forth herein, are specifically incorporated herein by reference.

Alavidze, Z. et al. Silk route to the acceptance and re-implementation of bacteriophage therapy. Biotechnol. J. 11, 595-600 (2016).

Altamirano, F. G. et al. Bacteriophage-resistant Acinetobacter baumannii are resensitized to antimicrobials. Nat. Microbiol. (2021) doi:10.1038/s41564-020-00830-7.

Aslam, S. et al. Lessons Learned From the First 10 Consecutive Cases of Intravenous Bacteriophage Therapy to Treat Multidrug-Resistant Bacterial Infections at a Single Center in the United States. Open Forum Infect. Dis. 7, (2020).

Blanquart, F. & Gandon, S. Time-shift experiments and patterns of adaptation across time and space. Ecol. Lett. 16, 31-38 (2013).

Brockhurst, M. A. & Koskella, B. Experimental coevolution of species interactions. Trends Ecol. Evol. 28, 367-375 (2013).

Briissow, H. Phage therapy: The Escherichia coli experience. Microbiology 151, 2133-2140 (2005).

Buckling, A. & Rainey, P. B. Antagonistic coevolution between a bacterium and a bacteriophage. Proc. R. Soc. B Biol. Sci. 269, 931-936 (2002).

Capparelli, R. et al. Bacteriophage-resistant Staphylococcus aureus mutant confers broad immunity against staphylococcal infection in mice. PLoS One 5, 1-13 (2010).

Chan, B. K. et al. Phage selection restores antibiotic sensitivity in MDR Pseudomonas aeruginosa. Sci. Rep. 6, 26717 (2016).

Conly, J. M. & Johnston, B. L. Where are all the new antibiotics? The new antibiotic paradox. Can. J. Infect. Dis. Med. Microbiol. 16, 159-160 (2005).

Fish, F. Phage therapy for the treatment of human intestinal bacterial infections: soon to be a reality? Expert Rev. Gastroenterol. Hepatol. 00, 1-4 (2013).

Fish, R, Kutter, E, Wheat, G, Blasdel, B, Kutateladze, M, Kuhl, S. Journal of wound care: Bacteriophage treatment of intransigent diabetic toe ulcers: a case series. 7, 27-33.

Gaba, S. & Ebert, D. Time-shift experiments as a tool to study antagonistic coevolution. Trends Ecol. Evol. 24, 226-232 (2009).

Gandon, S., Buckling, A., Decaestecker, E. & Day, T. Host-parasite coevolution and patterns of adaptation across time and space. J. Evol. Biol. 21, 1861-1866 (2008).

Green, S. I. et al. Bacteriophages from ExPEC Reservoirs Kill Pandemic Multidrug-Resistant Strains of Clonal Group ST131 in Animal Models of Bacteremia. Sci. Rep. 7, 46151 (2017).

Green, S. I. et al. Bacteriophages from ExPEC Reservoirs Kill Pandemic Multidrug-Resistant Strains of Clonal Group ST131 in Animal Models of Bacteremia. Sci. Rep. 7, 46151 (2017).

Green, S. I. et al. Murine model of chemotherapy-induced extraintestinal pathogenic Escherichia coli translocation. Infect. Immun. 83, 3243-3256 (2015).

Johnson, J. R. & Russo, T. A. Extraintestinal pathogenic *Escherichia coli*: 'The other bad *E coli*'. *J. Lab. Clin. Med.* 139, 155-162 (2002).

Johnson, J. R., Johnston, B., Clabots, C., Kuskowski, M. A. & Castanheira, M. *Escherichia coli* Sequence Type ST131 as the Major Cause of Serious Multidrug-Resistant *E. coli* Infections in the United States. 55417, 286-294 (2010).

Leon, M. & Bastias, R. Virulence reduction in bacteriophage resistant bacteria. *Front. Microbiol.* 6, 1-7 (2015).

Levin, B. R. Nasty viruses, costly plasmids, population dynamics, and the conditions for establishing and maintaining CRISPR-mediated adaptive immunity in bacteria. *PLoS Genet.* 6, 1-12 (2010).

Ma, L., Green, S. I., Trautner, B. W., Ramig, R. F. & Maresso, A. W. Metals Enhance the Killing of Bacteria by Bacteriophage in Human Blood. *Sci. Rep.* 8, 1-11 (2018).

Poullain, V., Gandon, S., Brockhurst, M. A., Buckling, A. & Hochberg, M. E. The evolution of specificity in evolving and coevolving antagonistic interactions between a bacteria and its phage. *Evolution* (N.Y). 62, 1-11 (2008).

Rhoads, D. D. et al. Bacteriophage therapy of venous leg ulcers in humans: results of a phase I safety trial. *J. Wound Care* 18, 237-243 (2009).

Schooley, R. T. et al. Development and use of personalized bacteriophage-based therapeutic cocktails to treat a patient with a disseminated resistant *Acinetobacter baumannii* infection. *Antimicrob. Agents Chemother.* 61, 1-14 (2017).

Seed, K. D. et al. Evolutionary consequences of intra-patient phage predation on microbial populations. Elife 3, e03497 (2014).

Shabbir, M. A. B. et al. Bacteria vs. bacteriophages: Parallel evolution of immune arsenals. *Front. Microbiol.* 7, 1-8 (2016).

Wright A, Hawkins C H, Anggard E E, Harper, D. A controlled clinical trial of a therapeutic bacteriophage preparation in chronic otitis due to antibiotic resistant *Pseudomonas aeruginosa*: a preliminary report of efficacy. *Clin Otolaryngol* 34, 349-357 (2009).

Yen, M., Cairns, L. S. & Camilli, A. A cocktail of three virulent bacteriophages prevents *Vibrio cholerae* infection in animal models. *Nat. Commun.* 8, 14187 (2017).

4. The composition of claim 1, wherein the amount of the bacteriophages in the composition are substantially the same.

5. The composition of claim 1, wherein the amount of the bacteriophages in the composition are not substantially the same.

6. The composition of claim 1, wherein the composition is in a liquid formulation or is in a solid formulation.

7. The composition of claim 1, wherein the composition is housed in a delivery apparatus.

8. A device, comprising, on, in, and/or around the device, the composition of claim 1.

9. The device of claim 8, wherein the device is a catheter, drive line, syringe, tube, implant, defibrillator, artificial joint, pacemaker, screw, rod, disc, intrauterine device, pin, plate, stent, dental device, eye lens, shunt, valve, neurological or neurosurgical device, gastrointestinal device, genitourinary device, catheter cuff, vascular access device, or wound drain.

10. The device of claim 8, further defined as having a coating comprising the bacteriophages.

11. A method of treating or preventing an *E. coli* infection in an individual, comprising administering to the individual a therapeutically effective amount of the composition of claim 1.

12. The method of claim 11, wherein the bacteriophages are in the same formulation.

13. The method of claim 11, wherein the bacteriophages are not in the same formulation.

14. The method of claim 11, wherein the composition is administered to the individual intravenously, orally, and/or upon a device.

15. The method of claim 11, wherein the composition is administered multiple times to the individual.

16. The method of claim 11, wherein the composition is administered once a day, twice a day, once a week, twice a week, once a month, or twice a month.

17. The method of claim 11, wherein the composition is administered twice a week for 6-12 weeks.

18. The method of claim 11, wherein the individual has an infection in the urinary tract, blood, gut, abdomen, stomach, lungs, skin, kidneys, prostate, bladder, brain, vaginal tract, heart, liver, spleen, or a combination thereof.

SEQUENCE LISTING (7 sequences)

SEQ ID NO: 1 - protein, 516 aa, Escherichia phage
  source 1..516: note = HP3
MSNNTYQHVSNESKYVKFDPTGSNFPGTVTTVQSALSKISNIGVNGIPDATMEVKGIAMIASEQEVLDGTNNSKIVTPATLATRLLYPNATETKYGLTRYSTNEETLKGSDNNSSITPQKLKYHTDDVFKNRYSSESSNGVIKISSTPAALAGVDDTTAMTPLKTQKLAIKLISQIAPSEDTATESVRGVVQLSTVAQIRQGTLREGYAISPYTFMNSVATHEYKGVIRLGTQTEINNNLGGVAVTGETLNGRGATGSMRGVVKLTTQAGIAPEGDSSGALAWNADVINTRGGQTINGSLNLDHLTANGIWSRGGMWKNGDQPVATERYASERVPVGTIMMFAGDSAPPGWIMCHGGTVSGDQFPDYRNVVGTRFGGDWNNPGVPDMRGLFVRGAGTGGHILNQRGQDGYGKDRLGVGCDGMHVGGVQAQQMSYHKHAGGWGEYNRSEGPFGASVYQGYLGTRKYSDWDNASYFTNDGFELGGPRDAHGTLNREGLIGYETRPWNISLNYIIKVHY

SEQ ID NO: 2 - protein, 516 aa, Escherichia phage
  source 1..516: note = HP3.1
MSNNTYQHVSNESKYVKFDPTGSNFPGTVTTVQSALSKISNIGVNGIPDATMEVKGIAMIASEQEVLDGTNNSKIVTPATLATRLLYPNATETKYGLTRYSTNEETLKGSDNNSSITPQKLKYHTDDVFKNRYSSESSNGVIKISSTPAALAGVDDTTAMTPLKTQKLAIKLISQIAPSEDTATESVRGVVQLSTVAQIRQGTLREGYAISPYTFMNSVATHEYKGVIRLGTQTEINNNLGGVAVTGETLNGRGATGSMRGVVKLTTQAGIAPEGDSSGALAWNADVINTRGGQTINGSLNLDHLTANGIWSRGGMWKNGDQPVATERYASERVPVGTIMMFAGDSAPPGWIMCHGGTVSGDQFPDYRNVVGTRFGGDWNNPGVPDMRGLFVRGAGTGGHILNQRGQDGYGKDRLGVGCDGMHVGGVQAQQMSYHKHAGGWGEYNRSEGPFGASVYQGYLGTRRHSDWDNASYFTNDGFELGGPRDAHGTLNREGLIGYETRPWNISLNYIIKVHY

SEQ ID NO: 3 - DNA, 75007 bp, Escherichia phage
  source 1..75007: mol_type = genomic DNA; note = ES17
ggcctttctctcactctttaaaggggaactaaataaacgggtaggtaatgaataggatggtatacacggggaaagaataacggggagtaggcacggggaaaggtggaacgttgaaagggaaggtaaaggcattgccaataacccttttttaaatgaggactccccctttttaggaaacacgcggcgagcggctagccccactcggtcaaatcagaattttaaactcttatatataaggttgaaagagaacttatgtggaaaattaagttaatcattaagcaattcaaatgtgatcatgagtactatcggatacgcaaagcttacggggatgaaagagttcacaccctttataagtccacttggagatgtagtaaatgtggtaagcttaagcacagcacatggatggacagaccttaacgtgacatggcctttatgggggtgccttaatgtgaagtagtcatcaaagatgacgtcccctttatgtcttaactttatcagagggatgtatgactgaagatgaattaatgaacttgattaaagtgttcgggtttacatcagaggatacagtgaacatgacagaagatgaatacggtagcttctctgaagaagactacgaaaatgaatacaggtactctcacgggtgttaatgtgatgtggcctttacgggttgatcttatgatgtgccctttatacttttattcagaggataagaatatgaggtttttaaaagaactacactccttgatttataaggacatagtgtactcagtatcccgcaatgcatggttctaccaaaagggtggcaacggtgaatgggtagattgaatcttattcagaggagaagaattatgaatttagtattagactttttatcagagatggtgcctcggttcagaacagagacatacgcttttgtagtcaatagtgactctgaagaagggatggaagctacatgcttaggtcgacttgttgatttagatgatgaaacagatttcgatattacaattgatgtaagtagttttggttggctcttcttcagagcattccgcacttacagaaaagaaacatacaaagattacagcaagggagatacaaatgaataatttaatccaagcgatggaccttaacgattacaattcacagctatgtcgctctggttgtagcttacagcatttagaaactatgggaaatgtttcaggattggctgtacaagatttatatagtggaagtattcttaaaccaactattacggagaagaaagatatgatgagtttagtagaacaataccgtggacttcaagtcggtactattggtgataaatatgagaactactacaaagatcgctcaaaagtacttgaagaagttgcacgggctaagccttctactctggaagtagttgaatatgaatctactaaacatgatcacctccctgactatgctcgtgcaatgattgagatgattgaagaagctgaatatgaaatgctccatgattacattacctccaaagatgaatggcatcgtgatgttcgaatcgaagaggatggtacagaaacaattacgtggattcataagagtgagctagtagacgacgcactgcgagactacgaaaaatttttggtcgacggctctattcttttagaggaagagaagggtgcagaacttccgtgggaaggtgagacgattgctctaggtaagatgtttaacctgtccgttggtgattgtaagtaatgtttgcctccgttgggaggctttttgtgttgttgataatgtagaaggagtataaaatgtttggagaaaacggagaactcacgcctgcacaggtagctgaggttacaggaagattacccggagtaacggaagaactcgaaagccgtggtatgaacccaagcaatgggaagtttcaaaagggaaataaattcggacgacccagaggtagtagaggtaaactgacacaattaatgttggaccgtgttgctgcaagtcatttgtctcctgatgaagtgttaattcaaatttacgaagatcctaatattccacctgatcttagattcaaggctgcatcaaaagttgcagatctggtatatcctaaggcggcctctgttgaagttaagattgaggaagagaatgtaatcaacgaagaatcattgaatgcacaaatcaaggacttcttgactggagcacttggtatagacgttatgcctccagaagaagacaactctgaggacgctgaaaagggggaggaagcggacgagagttaagtaaaggaaacagggagctgtcgaagatcatctgattaacaatctaaggattgttatagttttattgccacgatgttcttttgcagtgtacccttgtagtggagaggggaggttctttgacgaagggactttcccttttctatttttaaactggaggaagcatgtcattagataaacaaatttatgaagctctaactggtaacaatcttagtgtagaggaaaagaaagcactattgaatatgttgaaagagcgtgaccaatggaggaagtataataagattttgtctttcaaggcgtatgacttccaaaagaaattttatgcagcaggattgaagcatcgctttagattcttgtgtgcagcgaaccgtgttggtaaatcttatagcgaggcatacgagtttgcttgtcatgtcacaggtcgctacccaacttggtggacagggtataaatttaaaagacctatcttagcatgggcagttggtattacaggggattccacaaggaaagtattgcaaaaggaattgtttggtacacctatcggaaaggatacaaatttattggggacaggtgtcattcctcgtgatgctatcgtcattgacacgatagaacgagatggtaacaaacttcaaatcgtacaaatcaaacatcaaaatgaaagaggggagtttgacggtttaagtacattagaattccgctcaacccaacagggtgaacacacattgatgggtgcaacagttgactacatttggttagacgaagaagatccatacgagtctatggctatattcgcacagtgcgtcacacgtacactcacaactaaaggtctagttacaattacagctacaccagagaacggtttaactgaactggtagataaatttatgaaaggtgaaggggatgagaacacaggttctctatatttccagaatgcttcttggtgggatgctcatgcagacctaggtggacatatcactgaccaagatataaaagatatgactgaaggtattccagcgtggcagttagagatgcgttcgaaaggtatgccattgttaggaagtggtttgatatatgatgtatcggatgacacaattaaatgtgaaccattcgaaattccggatacgtggaaacgtgtctgtgcaattgatattggtattgatcacccaactgctgctgtttggacagcttacgatgcaaacactgatactatctatgtttacgactcgtataaagaaggtggctttactccagtgtatcatgctccagctattaatggtcgtggtcagtggattcctgtcatcctaccgcatgatgcggacaatattgagaaaggtagtggttcatctgttgctcaattctataaaaatgcaggagttaacgtacagagtgagaccttctacaacaaaattggaatggatggtaaaaagaacttctttgtagaaccgggaatcacagatatccgagaaagaatgatgagtggacgctttaaaatctttaacacagccgctaacgctaagctattcgaagagaaagctagatatcaccgtaaggttggtaagattattaaagaacatgatgacttaatggatgcaatgcgctattcagcgtgctctgttacacatcgtggtcgctctaagcatgacgttagctacggaagtgcttctctgtatgaggcaaacgtaagcagatggaatcagagttactaaagtaagggggaggtttgtcctcccttcttttatttaagctatcaaccgagggagagaatcgatggctaagcaaaaatatagtgaagaggtgttggacgagttacgtgttgaccttcaacgtcgttttaattacgctcaaggttacgtggacatggctgttaagggctatgctcgtgaagcttgggaatatttctatggtaacttacctgcaccagtaactgctggcagctctagttgggtagatcgtactgtttgggaatctgttaacggtacattgcaagatattattaacgtattctgttctggtgatgaagcagttactttcgtagctgacaaccaacaggattctgatgctgctgatgtagcaactaaactagttaaccaaattcttctgcgtgataatccgggatacaatattatctcttctgctgcacaagaatgtctagttactcgtaactcttttatcaagtattattgggatgaacaaacttctactcaaactgaagaagctgaaggtgtaccaccggaagcattggctgcatatgttcagggattagaagctggtggactcaagaatctggaaatcttcactgaagaaaatgaagatggtacagtggatgttaaagttacttacgaacaaactgttaaacgtgtgaaagttgaatatgtcccttcagagcaaatctttgttgacgaacatgctacctcttttgcagatgcacaatacttctgtcatcgtgttcgtcgttctaaagaagatctggttgctatgggcttccctaaagacgagattgaagcattcaacgactggacagacacgatggatactactcaatctacagttgcttggtctcgtactgactggcgtcaggatattgatgctgatattggtacagataccgaagatattgcttctatggtttgggtttacgagcactacattcgtactggtgttctagataagaataaagagtctaaactctatcaggttattcaagctggtgagcatatccttcacactgaagaagtaactcacattccgtttgtaaccttctgtccgtatccgattccaggctccttctatggtcaatcggtctatgacattacgaaagatattcaagatttacgtaccgcgttagttcgtggttatattgataacgtcaacaatgctaactatggtcgatacaaagctcttgttggtgcatacgaccgtcgctctctgcttgataaccgtcccggtggagtggttgaaatggaacgtcaggacgctattgacctgttcccataccataacctacctcaaggtattgacggcctcctaggcatgtctgaggagcttaaagagacacgtacaggtgtaaccaaactaggcatgggtatcaaccctgatgtgtttaagaatgataacgcttatgcaactgtaggcttgatgatgaatgctgcacagaaccgtctccgtatggtgtgtcgtaacattgctcacaacggtatggttgaattgatgcgtggtatttacaaccttatcagagaaaatggtgaagtccctatcgaggtacaaacccctcgcggtatgattcaggtaaatccgaaacaattaccagctcgtcacaatctccaagttgttgtagctatctctcctaatgagaaagcagaacgtgcacagaaactgattagcttgaaacagctgattgcagcagatgcacagttagcacctctctttggtttggagcaagaccgttacatgactgcacagatctttgagttgatgggtattaaagatacacataaataccttctgcctctggaacagtatcaacctccagaaccttctccgatggaaatcctccagctcgagatgactaaagcacaggttgagaacgtacaggcttcttctcagaagatgattgctgatgcattcgaccaacgtgaacgtactacattcgaacagcagaaagctgcggatgagttaagtctgcgtcaggaagagttgcagttcaagcaagaaaatgcagcagatgctatgactctggaaaaccgtaaagaagataacaatgctactctggaacaagctaagcacaagttagctcttatgcaacagcaggtccgtcagtatgaatctgtactgaaagaattgcagatggttatgtctcatcaggtagaccaagagaagattgttcagcaagctcgtgttcaggacaaaactttggaactccaaaagaaagaagctaatgtaactaagaaagagcaacaagcttctctcaaagattcacggattccaggcaaacgtcttggaagtaaaaagtaaggacgtcgaatgaacattaggcatcaattcaataaagagcacgccgccgctttggcggctctcaatcttaacggcagtcttgacgcagcattagaggcattgaaagaaagactcatgacagagatcgtacaaaccgaacctcatgagaataagaaacgcgaagattgttatcaaaagtataaaatggtgggtagcttaaaagaggtcataaaagctgctatcaatagtgcaggagatgtttcataatgccacaagataattatattgacccgaacgattttaaatctttcctccaactggatgacctgaaaggttctttcaaagaagaactcggtcgattagaatctgaacaagaaccagaagtggacattgacgatgagttcccggaaaaagacggtgacgatttcgactttgataccgaccttctcggtgaaagcgatgagcttaagttcgaagatgaagatggttgggaagatcgtgaagaggaaggcgaagtcgaagaagatgaagacgaatcctctgaagcagaagaacaagaggaagaagattcaagcgatgcagagtatgaagatgattctgctgacggtgaaggtgaagtctttgatgtagactacgaaaccgttatcacccttcctgatggacgtgagatgactattgaagaactttctaatggctatcttactggtgctgatatgacagaacgagaatcaactcttcagcgtcatatggaagcattcgaggaacgtgtagtaggtttgaaggatgtattagaactagcgtctttagaagcagaccgagtaattgaagattataacggttttgattgggacaagcttgcagtagaagatcctcaagcatatgttgaaaacaaacgtttcctagagaagtacacagctcgccgtcaacagcttgaacaggctcaggtccgtattaagcaggaagcagcagctaaagagcaggaagctttccaagccaagagtattgaatgtgttaatattctgaaacgtgagattccaaattgggatgaaaacttatatcaaaacttaatgcaatacgcaattgacttaggtgctactgaagaagaagtattgaaggaaaaccgtccgtctattttcctagctctccataaagcataccaatttgataaaggtaagcaacaggtgatggctaagattaaacgtcccggtgctccacgcaaggttgtgaagtctgatgctgcaaagtctcgcacttccaataagcccgacaacgctaaggttgccaaggcattcgcagagggtcgcgttagtcacgaagacgcattcaaattcctcgtagattaatcgacaaattaaattattaatagtataggagctaacataacatggctaatccaactttatttgtatcgtatgaccagaatggtaaaaaactttcttttgctaactggatttctgttctgtcccctcaggataccccgttcgtatctatgaccggtaaagagtctattaaccagactatctttagctggcagaccgatgcactggcaagcgttgacggtaataacgcacacgtcgaaggctctcgtgctgaagacggcgaaatgaaaccgactgttatcaaatctaacgttactcagattctgcgtaaggttgttcgtgtttctgatactgctaacaccaccgctaactacggtcgtggtcgtgaactgatgtatcagttggagaagaaaggtaaagagatcaagcgtgacctcgagaaaatccttctgtccggtcaggctcgtaccgatgttctggctgaccagtatctgactaactccgcagctgatcctgctgttgctggtctgaatgacacccatgcagctcgtaagactggtgcattccagttcctgtgtgctcacggcggtcttgctggtggcgttgttgacaagaccaagaatggtcctgctgacccggatactggtgcagtaactgttaaagttgcacagaatgcttctaacccgaccactaacattggtttcgacgaagctgatatctttgatatgactctgcaactgtataccgctggttctgaagcagatatcatcatgattaacccggctcatgctaagatctttgctggtctgcaagaaaatactcagggttcacgtaagcgtatctttgagaacaccaagcagttcatctacgaagttaacagcatcactgacccgctgggccagagctacaaaatcatcgttaaccgttggatgcctaccgatgcagtttacttcttccgtagcgctgactggacccagatggttctacgtgctccgaaacgtactgaactggctaaagacggttcttacgagaagtggatgattgaaatggaagttggtctgcgtcaccgcaacccgtatgcttccggcgttctgttcactgctgcgggaaaggtggcggcgtaacagtagacagtgtgactgttagccctgcgtctttagcaagcctagagacaggggctactcggcagttcactgcaagcgcggagaaaagtgatggttctaccgaaacaactggctttacttggtcagtgacaggaggtggttctatcactcagtcgggtttgtatactgccccgagtgcgtctcaatccactgatgtatccattactgcaactttagaaggtgtttctggtacagcaaccatttctgaaattgttgctcctactcctactattgtgagtcgtgggccaattacaggtaaagtaggtggtactaccactaacttcaacaccatgtttactgtaactaattctattgctgatgattacacacttgttgtaactcccgcagaagctggtacaataagcgctaataattcgttaaaattagatgctgctgcaagtggcgaagttactgttcaagcaagtttgacagctgacccgtccatcaatgcaacatgcacttttactggtgtaacacctgcttaaaaactagaccctgccttcgggcggggttttttcgttttaagacctatacaagctagtgtgtaatgtatattctttgtctacatacaacaaggaggacaacctatggcgatgccagatgtggcctatccgattaacacgtatggctggcttaagaaagctgttgccttgtgggccgatcgggacgatgacgaatttgttaatcaaattccaaactttattaactttgcagagaaagaggtttatcgtaacttacgtattcctcctctggaaaaagaagtgtatttagatattaaagatggagtggcttatattcctcctgattacttagaagctcaatggatgatgagagccaaagatggtacaatcttccaagtaacatctcctgaggagataagctatcggagacagcacggggctattaactcttcacattggaataaccaacctgttaattttgcacggtttggagcacgtttcttattctatcctagaataaatgcagatgttccgcattaccctgatgatggtagtccgattgttccagcggagagttcggtaatcttgagttattatgcagatcctccagaatttcacgaagatggtgatacaagtgcgattcttaccattgcaccagagcttcttttatattttactctgaggcatgcatgtttatttgttcaagatgataatggggttcaaaagtggtctgctttaggtaaggctattcttgacgagctagtagaacagaataagaaacaagagtactcaggttcacctattgcaattccgaataacatgactcgacttcagagcagcctgcctgatatttatggtattcgtacttctcgtctataaggagataatatgatcgtttataacaaccaagcacctaagaatgttaacaatgtaggacaatttggagctactgagggaactattggtgcttataaatcagcagctgaatatgcagcagactctaaatattgggcattgttgtcccaaactaaatactcctcagtagaggagattttggctgaagtagaacgtctgtatgctcaaggtcatctactggaagaagacattaaacaactcaagagtgactttgagtcacaagaacaagtgctcttaggtttgattcaatccacaggaactgcaattgacaacaccaatgcagcaactgagctttcaaaagaggcaactcaaaacgttctagcacaacttgacattatctctaacatgacagttcaaacaacgcttcttcctccgggaagcctagctacggggtcttatgataatgcaacaggtgtctttgcttttggtattccagaaggtaaaccggggcgtgatggtactgacggaacaatcggtgatattggaagcgttcctgttggtacccctgttgttgatgactatggtttctatgtagataaagatgatggtggtttataccgagctgacatgtcagatattgccaacttgattccatctgttcgatctgtttcaatcaatggcggcgctgaacaaacaggttcagtggtttttgattctgtctccacattcaatggacgtaagggtgctgtagttcctgctactggagactacacagctgctcaagtgggagcttttagtgtaactaataacctatccgaaataaccgacacaagtgcagctattacaaatattggactcgctgagcatgggattggtagccctaccttaaccaaagtgaaggctatggactggcaaacatttaattttgtcaatggaggtaactattcagtattaatgtcgaatattacaaatgcccctgctgagataaattatcctgccaattatgggttatatcttgaagtcattggcgtagttacaggaggaggtgaggtacgagtggtgccagggacaaacaataataactactactcagttttctctgtaagctggactggaggagttggttcccgagtatttacagtacgagaagagctgtcttccgctcgccctgtgactatctctcagggtggcacaggggcaactactgcaagtgctgcacgtactaaacttggtttaggtttggtttccactgaatcaattgtacctattaccaaaggtggtacaggagctacttcatcagagaatgctcgactagctctagttgcagctaagagtggtgataactctgatatcacctcgatgaccaacaaggttactttcacacaatctccagtaattcctgatgctgtagatgataatgacgcggttgctttgagacagttgcatacaagtgaagcagatttgctggcaaggctgaaaagtagtaatgcaggtgaaggtgcatcccttattacctttgaaaatggtaattctgttgagagtctttccagtaaagatggggctaaaaacattggcagtggtgagagaagtttgcttgtccgtaacaacgacattaagcattcaggagatttccctaccttacaagctgcggtaaatgcatcgttaccaaaaaacgacttaattgtttcccccggtgaatacagtgaagcgattactattggtagtacacagttaaagggtgttggtggagccacggtactgaaagctccgtcaaactttacagacactattcaggttaaggcatctacgcctcattggcaattccgccatagtggtggttttgctatagatggttctgggacaaccggggctgtaggtattagttttgacccgaccgaccaatatgctggtcgtcacaactttagtgacgtatacatccataacattaacaaggccattcagaaaccttccgggaatataggtaatacatggaaaggcattggcgtgcaaggttgtgactggggttactgggcacagtctgcttctgagatgcacttaggctctgacacccttcagaacatgcactttgatggtattagcacttactgtgtttacttgaacgctacaacaggagaagcgcctggtacattcggaggtggtgtaggcggctggtggattaaagatagtattatggaagcctctggcggtggtggtatttacctcaagaacaaggatggtgactgccctactgccccatgtggtgtatccaatgtatggatggaagctatcgctactactccagctattaatgtagatggtgtatctcagaagcctcgtgtccttaaacttattgataccagtatcttctttgcagagtacacataccttaataacgtagagcttcagaactccaaccttgttacttatggctgccgagtagataattcagatggccacatggatatctctgtagatgccaacagcagttttgtggctgatcaattgtacctgaatggtagctccggcaaagatgtaatggtacgttctgtagcggctcagacaggcaagattgggcaaagctggacacctaatatgagtatgcgtggatacctgccggaaggatacatctatcgtgtacctggtaataagctggtagttaaacccttcgatggaggtactgctgaatttagtggtacggcaagcagcactgggagtttgcagccacaaggccagttatctcagagctgcatgtacttcgaaatccctggtgctgctgagtatgagcttactggtgctgcatttcagataacttccggtaactggtatgtatggggcattagcactgaactggtacagggaacccctacaaacttccgcatcggtggagatatcaatgtaggtgaagtatttactaaggggggccagtgggtgagtacctttggtgtagctcaggctagtgcttccggttcagtgaacctgcgcctaagtacagccggtacaggcggagtagtcctacgcctcgctgattacttcgtagcggagttcactactcaggcagaggctatgcgcttcgctaatagtagacgtgccctgcgttaagagtaatgacattactataagcaaaaccccgcttaggcggggttagcttccatagggtagttgttttccctgatgtagtggaatttatcggagacaatgagctggctgctttgttgcattctgataaatagttcataactccccttcgaggcctttagtagtaagtacctttagtaagtaatgaaactaatatatcccaagaggttaatacataggagacagataaatgaaaatgatgaaacaagctgcatatggtttaatatgcttaggcgcaggtgttgtggtatccaccgcagttcctgtaggcgcagttcatccattagttacagcaccttctccagtagagaagcttagctctcaatgtaaacagagaacaattcaaaataacctagttgttatttgtcctgatgctgaatctaacgctctgagaaagatactaccttaatttaaagggaccacaaaaggaggttagaaatggataacgccgcattgccacctgtacaattaaacttaagcccagctggaatggaattcattatgaagcatgaaggtatgagaaccaaggcttataaagattccgcaggcatctggacgatatgtgtaggggctacgcgcgatatgaatggttatccggttagacaaggattaacgtattctatagaggattgtctagctctgctagatagagacacacaagactctgttcgtgctactcagaagaacataaaagttcctttactagttcatgagtttgatgcactcacttctttcaattttaatgttggaagtggtgctttgagcacatctaagttaaggaaggttatcaatggagatgttaaaggggatatttattccgaatttcttcgttgggataagataacggtcaagggagtgaagcagagaagtcagggtcttcataacagaagggttgcagaagctgatctttataccgaaggtaaatattaatggaggtgcctcttggctattgaaactaatgcggtagtagttaccgacttaaacccactctatcctcgtgatagagattatatctatgaaggtgcagcccagctgcgcctagttaagcaagtattacagaacacattccccaacttaactgagcctatgactgtaaactctgacacactagctgctatctctgacaagatctcttttgctggtgactatatggatgttggtggtttgatgattaagaatggtacagcaggtactggtaataacgactttaccaccaaagcccaaatggaatcttttatgctcaactggatgcagaataagatttacagggttgggtcttattacatcactgaggaagatattaacccgggagattctacatctttagggtttggtatctggacacaagttactggtgttatcatgggtgctggggttgtgacccctgatgggacagtccctaatgctcagcgtgtggagtttactgctggtgctacaggtggtcgtgtttacaacacagttaagacagagaacctgccattgactacaatctctggttcaagtttttctctttctaactatacacactcacatactacatcatttggacgtggagatgcaagtggacataacagctcacctaactggtataatccgggggttagttattctgttgcatcaagttctgatactcacacccacaccattacaggtgatgcaacatttggctatgatgatgtatctcgtcaacctataaatacgttaccacccttccgtgcagcatatatctggagacgtatcagttaaggaggaagtatggctctttacccaataaaatctttgggtgcggttggtgttattgccgaccaatctcctacagatctggctcctaatgcatttactaatgcaattaatgctcggtttgtagaacagcgtgtgtttaagacggggggctctgcccctctttcttacgttgaaagtgataaagaaataagaccattatcattcacttcaatgccttttgactacttcagtgctaacaatagtttcttactggtaggtacagataagagtatttttagattaaataatgaatctatggttgatgttagtcgaagagtggctacagtcaccaaaaaagcagtatcttatgtcaagataaaccccgtactaacagagatcgtccctaaagaaacatctgttattatgaatcttaatgaaagcaaggttctcgaggtatctcttcttccagaaggtgttgttactccatcccttgtgtgggaggttagtaatccctcctatggttcaatattagttgaccctgatgatagtaagaaagctacattgagtgtcttatctaatgagggtagctttactgtcactgtctctaatgaagatgaatctgtaactaccagtatctccgtaaaggttgttgattctgattctggtatcttccttaaccgggactctgttcaacttcgtaaaggtggaacaaccacacttacagcaacaaccagcaagaccccactaacgtggacttcttctaacccgtccattatatctgtggcgcctaatggtgacactactacagcaatattaaccgctcaaggagtaggtaatgcactgataacagtaagcaatgggtctaaaacctcggaatgctctgttagtgttatcaatcagattgacagtatatctttaagtcaaacagatttacaaattaaccgtgggacgtcatatgtcttatactctagtttaattccatcaaatgctgcaaatcagagaataacttggacttcctctaacccaaatatcgccactgtttcgggaacaggtcttcaaggaactgtctctgggttaactgctgggtttacagttataacagcaactacggaagaaggtgaaaggaccgccacctgtaacgtcagggttgagttatcaagtagggcccttttttctgctgcatcagctccttctgaagaacctagttctacggattcagatattgacacctcatctatgtcagagggcaatgctttttatgactattctatggttgatggtgttgaagcctattctataaatgaagtcatgtctaggtcaactcagcttgaatccttaactcttgacattgtggatactgaaattgatgttggagatgagttagtaataactgcaacggcattccctgaaggggagtacctttataattgggtggtagatcagccggggtatatatcctctacttccactaccgactcttcctttaccttaactgctattaagactggcaaagtgaagataacctgcactgctagtcaagtagctcgtagagactatgaagcatttgagaagtatccttggtataatacgattatctctaactgcgcagtattcactactcactacgaaacccctcaagtaaaagagtttgcctctgagtatttcacagatcttccggggtggggtgagcagacaatagtagatgctaatgggaacccttctgttgtaaaatataactggaagtgcgaaaggattcgtgcatttaataatcgtctatttgctcttaatatgcgagagtctaatgcatcaggagttactactcactaccctcttcgacttcgctggtctaactatgctaatgagaataaggcacctactttatgggatgattttgcttatgatagatatgtgacttcagatttagcagcaaatgttgtaggtcaaactgaggctctagaaaatggatatgccggatacatagatttagctgactcaaacggtagcttagtcgaaattcttcctcttaaggattatctatttatctatacggagtttgagacttacattggatccccaactaacaacacatatcaacctctaatgttcaagaagctcttcaacgactctggaatcttagcacctgagtgtgtagttgaagttgagagcggacatttcgtggtcactcagaatgatgttattctacacaatggtgcaaccaagaagtctattgcatctaacagggtcaagaatatgcttatcaacgaagtgtgtttagtaaaccctttggctactaaagttcatcttcaccaagacaagaaggaagtgtggattctttatgtaggacccggagaacctgctgggagctttgcttgtacgaaagccgctgtatggaactatgagtttgatacgtggtctttccgtacaatcccattctctcattgtattggtttagtcgatcctcctactttagagaaaggtcctacttgggttgatttccaagagtacacttgggatgacccttcaatcagtgaacttgtgtggagaaaggattctactaacttccgtcagagagttactgtagtaggttcttggatgaaaggtttttaccaagtggacataggtccttatgactactcttatgataggctgaatgatattgttgtcaaaaagcccctagagatgagactggaaagaactggtatagattttgacaacgtaactaatgaatggaatcaaaagcacataaaccgattccgtccacaagtaaccgggtcaggtacgtacatattccaagctggtggtagtcagtattcggatcaagaggataggcatattcatagtgaaaagtcttatacaattggtgtggacagacatgtaggtgtccgactgaaccatccgtatctattctataatgttatagataatgatgttaacagtaatgcagcaatcaatggtctaactattgagtttgctgttggcgggcgaagataatactaagggagcttcgtgctcccttttcttgtttattataaggagggtctatgggtgctggtggctttcgtaagaataccggaagaaacaacacaacacaaccttatagtgtgggctttctaaacacctctgagagtgtagaaaccaataacgttgcaatatatgatgaactccagaacattagcactgcaaccaatcaaatgttccaagctatagatgaaatccacgaggagattgatgttcgtattaaagctcttcatgctatgaatttgcaattcgatgaattagagaaccgtgttacaacagagattgagactgccattgcagatatcataacacaaatgggtaatctatccactgatgatatttgggataactctgttcagcctcctgttaagttagattcaactatgtctggtattaagacttctatagaaggcaatacagcatctattcaaactgtcgaaggcattgtcaatgatcaaggacaagagattgcccttattcagtctgatttaactaacgggacaggtagtgcttctcaatatatgaaactcactgaatatgaagctacttggggagtaaattccacagtaaatggaaagacagcaggagtaaaactgacaaataatggttctgtaagccaattccaagtcacagctgataagtttgtggtatctgatggcacatcaggaagtactcccttcaaggttgagaatggaagggctgttatggagtttgctgatattactaatgtcaatattacaacagctcaaatagcaacagctaggattgaatgggcacagattgataatgttagtataacaaatgcacaaatcacaagtctctccgctgataagataacggctgggtctatgtcagggactaattggcgtcttacagttggcggtgactttgttttaggtggaacaggtggtgcacaattatggatgaatggaaacagaatagatttctacgacggaagtggtgctctaagaattagaatagggagttggtaatatggcatatggaatatggacacaaccagtagggccggggccagcaacccccgctcccttgtttattgatagcggaagtactttccctcagttcaagaatagtataagagggagctttaactttaatggagctgggagatctttccctattagtggatgggatggcagtggtcagatagttattgttcctaccggttctttatgctggcaatgggaagtccctcctaacctagttcctgatgtttattgtgtgaataatatctatgtagaaaacaactcctcttttagagttactctgaatcagaaccccggtagtaatccactattcgattgtgggttcaacgtatatcaaatatggcctagagcggataggaattatggaattaccttttctaatacagcagactacttctcaatatctgacagtggggtcgtcggtcaatgtatttgggcttggcaggggaccataaacaatgcccttcagataccaaatatcggtgggttcaatatgaccaatgctgttgtgtttgctaattggtctgatggaggggtaggactatcttatacctctgatgacagggttattcgcgtctatcagaacagaccctatgtcaacggaaacactaatgaaggagggtctgtctttgcgagggttgccgtattctgtaacggagctggtgttcctgagcataatggaggtttgaatatttactctccgggtaccacacaatgtgtcttctctactaacagaacacctttcactgtggatacttttataggatcaggaggtggtaacacgggaatgtcataccccatgatacctcttacctctgggataggtgcaataaaaggccgaggcagtggatggagatatcagcaaatgagatctcacacaatgagtggttctacgataggaactggctatggaaggtatttgtttcagtgggatcaaaattacgacctaggagctgatactgtagttaatttatcagtccctgtaataaatgcagctaaggtttttgctggactataacaaggagatattatggcaattaaaatgggtattgaagaactagacccaatggttcaacaggcttcaaagaagtatgggattcctgctgctttgattcatgctgtaatccaaagagagtctagtggtcgtcctacagtagcttctggaactggtcctgtaggtttaatgcaaatcagtaaagggttggctaaagactacggatataaattggaagatagattggacccagcaaagaatattgatatgggtgctcggtatatcagagacaacctaaaagcttttaacggtgacgtcaagaaagcaatggttggttattcagaaggtatcggcggagctaagcaaatgttcgctggtaaaagagggtttactccacaggctcttgattcaatgaacaataaacactttcttcctttctatggtgatgcagcttctcagattgctaaccctattggagctttgcaagctgttcaaccagttaaccagtttagtccggatactcttgatagagagaaggctgctcaagctccgactcaggcagaaattgctgcttctaagactggtgctttaggcggcaatccagtagagttttactctgatgaagcacaggaaggagaagatcagaagcctcaacagaactttggtaatgcagtattaggagtagctgctatgcttgctggtaaacctcctacttctcaaacagttcagagggcaagtgcaccacatgcagcaggttctcagtacagtccacaaacacaagcagtgctcagacgtttggctagcattggtgtgaagtaataatcgttaaggaggacttatgtctttatttggaaaatcagcttctagcaaaaccacagtggctccttcctctcaggttgatgccctgctgaagcagattgttgctaatgctcagaatatgcagaacaacgatcagggttttatttcccaacagctggctgggttcaatggcaaccaacaaggtgctctgaataacttagcagcttccacaactcaaaaacaattggctaatatgtacacacctcgtacacagcaaggattggaccaactaaatgctcttgcccaacagtatcagaatattgttaatagtggtggagtgacggctgaaggggttaataactttagtaaaggtttgaataactcagctcttgcacaagctactagcaaagcagcttctaatgtctctcttggtaatggctctgactctggctctctccgtagggctgcggctcaaggggctgctttgaatggtgctaacactaacctgtctcgtactatcagtggcaagaatatggggatcagtgctcttcaacaagaccaaaacttccagagaggcttacttggtgctcagtcagggttagctggacagaatctcaatcttggtgctcaaggtgttcaggcaactcaacaggctattcagaatcagctcatggctggtaatttacaacagcagcaagctcaggctcaagctgatatcaattggcagaacgctattggctctcagcagtatggatggaatcagcttaacaaccagcttaatgtactaaacagtgtaagtccaatggctggatacacaattaagaatgctgctccgggagttaatgttggacagcagctcctaggtgctggtatcactggattaggtattgcaggtcgtatgggtgctttctctcctaatcaacagactcagaatgcttggagttcctataacaactcaggtgggcaatctggaatggctggtcctatgattgggggttctaatctttctcaacagagaggtcagtctaactggttatccacagcaggtagtaatatcttaggtggtgtcttaggggcatttggagcaaactaaaggagaatatctatgtcactttttggtggaggcggaagtaaaactacttcccaaatgattcgtcctgaatacattcaacagtatattgaccagcttaataagcagattggtaataccagttcaggggattatgtttatcgagataatgtagggtttaataataaccagacagaggcacttaacaacttagcacaatctggtgctctaggaactctctcacagcagtatatggatgcagcaggtcaagggttagggtatctagataatgcctataaaggctatcagagcctctctggacaaggtgggattactggagaacagattggtgctctcgctggtcaattatatgatgatgacgctgtgcaagcagccattacagctaataatgaacaagttcaacagaatctagcacgtaatgctcttcctcagttagctcagcagtatgctggtcagcaaggttcaggtgctcgtatggctaaatcttttgcccaaggtgatgctctgaatcagatgcaagggcaagcaacagatattaccaacagtgcctataactcggctattagtcaagctgaaagcattctctctggtaatagacagaatcaggcagctgctctctctggtctttctactattggttctaacctttctaacctaggtcagcagggtgctaatttgtctcaacagcaaatgatgaatcaatggaatgcaggattgcagcaacaacagcaacaacagaatgaatatgataatgcctaccagaatgctcagaacgcagctaattggggatggcaagatatcaacaaccaactcggtgcagcaggtgtacttaacggtgctctcggacaaactacaaccactaaaacctctggtggcaaaggtggtttccttggtggagctatgagtggttcagcagcaggctcttcctttgggccttggggtgcattagctgggggtctaatcggtgggttggctagtacttaattaggagataaatatgcaacagacaacttacgctcaggtcagaagtcgtgacccgagaaatactttctatggtgttaatccgggagcggcttcggcctctccttatatggctagacccgttcagacagcagatatttctatgtatcaacgacctgctgtacctgctgggttatctgctcttgtaggtcaaacttcagttgattatcagaatatgttgaatcctgttcagagtaatggtcttccttctgacattccgaatgatgtacaacctcaatcacaacaggctgtaactcttcctgagtttgagaaccaagaaaccatgcaagctgctggactttctccttctgctattcctcaagaatcagaacctcttccggtaacacctcctactaaaccgctagaagctggtcctatggagtttactccttctcaggtagaacaggcacaaggtgtgattaacactcttgctcaaggacaagacactggtgatggaatggctgctgctactcgtgctaaagatcaagagcgtgttaacaacgatatcttgcaagttgcgaaagctaaagacccttcagaagcttggaacaaactacagaaagaaccattctatcagaactctagtttctatacaggtttgatgggtgtaggtctttccattatgtcaggtaagtctcctattgaagctttccagattggtcagggaatggctaatcaggatgagactaagaagcaactggaagctaaccgtgatgccttgattgaacaaggcttctctcaagactcgatcgcagctgctattgctaacggagacccgtctctactgaagatgagagctgtagaccctgctcagaaagaagcgctgtatgctgctcgtgaagaacgacaaaatgctgaatgggatagacgtcaacagattcaagagcaaactatgcgtgagcgtgctgatgaaactcgtcgtgccgctgaagaaagagctaacatgaactttgaacgtcagaaagagttgattggttatcgtgataaggttaaggctgaacgtgctgaacaagctgctcagagttttaactttaacccgaaagaagttcgtcttgctcagaatacagctgaaggtacggttgctaagcagtgggcagagaaaggtggcctgtttaaccagtctaacaaagacttggatttggctgataaagctgttaaggataaagactatcagacagctcgttctgcttacatgcaggctatcatgaactctgcaagagctgaaatcggtgctactcgttctcttaccgaagaagacttagggcactttgcagaagacccatcaatcttcgttcgtgttggcaacaagtttgcactgaaatctggatggcgtcctactgattctgctcttgcttatgctcgtaagcaagctaacgttggtcacacctctgcaatgaaaggtgttgctgatgctaagagagctacgattgaagcttacatcggttctggtatggataagaagagagctactgcattggttaaccgtgcaatcccttctggtggtttctatgaccctctaggtgttttctctgaacaagcagaagaagcagttggtggtgcagtaaccaatcctaagcttaatggtgctttatcagctgtcgaagacactagctggttcactcaataagacctaagtcctgccttctataatgtatatagggggtaggacatttttatttataaaaggagacgttatggctaacattaaaccgtgggaagaagcttccaaagctcctgcgtatctgaatgcctctccggagcaacaagctcaaatgagagaacaatataaggcagcaggtggctctattcctgaggaacaaccagtagcacaaccacaacaagaagaacgtggtgctataggtgagtttgctcaaggtgtgtcaaatgctcttcaatctggtggtgcaaatattgcagctagtgctgctaaaggtattggtggtttagttgagattggtgagaatctagctggagcacaaactagttatggtaagcgtatccaagagaactctcagaatcttctgaaagaacgtatggataagattgaggatgggattggtaaaactgtcggtcagtatgctggcgttgctggtgatatcggtttgacagttgctaacccattggctgctgctgctatcatcgcaggtcgtgagacaggtcgtgcatatgcagaccaaacccctgaagagggagaagataagtctattctagatgcagccttagttggtggtgctaactatgcggctcagagaatccttccgggtgctgtcggtacagctgagtccacacttggacgtattggtcagaacgttgctagtaacgcagtggctggtgctaaaggtggcgctcttgtgggtgctgctgaagctcagaacaagcatggagatgatacaacctttgctaatgtattagagggtgctatcgaagaaggtgctatgggtgctgcattcggtggtgcagttggtggagttcatggtttgattagccgtccagattctgctgtcttcaagaatactccagagtatgcgaagactgatattgctgctgatgatgaactaattcgtagtgctaagaatattgatgaactgaaagaagcttactctaaagctgaaactgctaacgctgcttctgctctgaatcttctggatgagaatggattccgtattacagatgctgttgctgtggattctcctgctgctcagcgtattcttaatactgaccaagctcgtgctgagaaagctgcttctgttcagaaagaacattccaacattccgggccttaatcctttagcttctcctgctaagactcgtggtaaagcatttgctgataatgagcacaaccagaagcaggctgttgctatgaaggatgcaatggctgactacaccaaagacaacacgaaagctcttacagatgttctagataacctagaccgtgaattaacttctctccgagcttctggtgattttactggtagtccgattgatattaagaatcgtacacaagctgaccgtgatttcattgatgcttacaagactttctacaatgaagcaaatcgattcaaagctcgtgaaggtgaagattttaataactttgtagagaaagctactgaactacagaagatggctgataatgtttctccagagatgaagaaagctatcggtgggttgaagaaactgaaaggtatgcctgaaggttttaatcctattcaagatgcttatactctgaacaatacagctaaattcatgagcaaccaagatcgtggttggacttccttgactgatgatggattccgtgaagcttcttcacctagtctggtaatgaacactcttggtgctgctaagtatgctctgaatcgcttctcttctcagcgtgctcgttctcaacgtgttaagcaacaagaatctaacagtgaagctatccgctctcttgctcgtggtgatttggaagttgctcgtgctaaatctactgctgatgaagctcgtgctaagatggaagaagaaccagttgttgatgacattaaatttaagacgcaaaatgacgtagaaaccgaaccggttcgggagccttcttctagtactgtgacggaagaaaatcttccttcttctactcctcaagagactcctcttacagctcgtgatttagttgcgcaaagacgcgctatccgtcaggctgaacagcgtcgcgctgaagaagaggcattggctgctcaagaagctccggtcgaacaggctccacaggctgaacctctccctgctcgtaaccctctagaggagcgtcgtgcaatggaacagcaacgtgctcaagaagaggccgcacaggctccagaacctaccgtagaggaaccaacagtcaaagctgagccattacctgcccgtgctcctaaagctcctaaggaagctgtacaggacgttaaaccggcaagtggtgtagaacgtttagctgctatgtctagtgctgctcgtcaggctactaaagatcgtgcagaacgctttgctcgttctctgtactctaaggctgctaaagctaaagctactgctgaaaacttcttggcttataaaggtgatcctaaggaactgatgcgtcgtattcgtcaggaagataatgctatcaacactgaacgtcatgaagaaatggctcgtaaccagttggcttctcagcaaggtattgctactgctaagaacaacactgtacgaactaattttgctgaatgggttaaggaacgtggtctgccagaagacattgctactaaggcattacgtgctgaagagaaaggtttaggtgggaacgtaactaacttggatagtctgaaacgtcgtgctgaaaggttgtatcagaagcagcgtgaagatgagtttgatagactgtaccaacaagctctagaagagaataaagctttcgataacaagaatgctcctaagctggttgaccagaagaaagagcttcagtctgagattgatactttgattgatgcagaacctttacgtcctgctcagaaagacgctatgcgtaaattgatgaatgactttgtagatggaaagtttaaatcttcagagaaggctggtagggaagaggctttggaagttggtcagatgaaggatatttgggatgggtttattaacacctataacagagaagtgaatgccttcaacaaagctaacaagaactctcagtacgaagctgctgctaagcatttacaggctcgtgaagaacgtcttgctacactcaggaaaaaggctcaggctcgttcggatgctaaagctgctgttgagaatgaacgtaaaactctagaggctattgcagctcagaagagtgagattgagaagatgatggaaggtttacctaaacctgttcgtgaggctcaggaatctcgtacactgaaacagttggctgctcaccacgataagaactctccagttcctccagagaagttccgtagttatattgaacgtattcacaacgccgagtcagattaccttgatcgtcagcgccgtttgactgatgcagaggaagatgctcgtcaggctaagtggaacaagatgtatgaacaagcggaagagatgaaccgtaagtttgatgtggacaagagagttaagcgcagtgaagagcttaaagcggcccaagagcgtgagaatgaccttatggcagtacaacgtcaacgtgatgacattcatcgccgcctgatgcgtactatggaagataagggcatatctagagaggatgctgaagcatttgctggttcctatatggataaccgttatgcacttcttgagaagcctatgactcctactgaacatcagaatgctcgttctcgtatcgaagctgatgttgagaagtttgctaagaagtacgaatcaatgactcctatcgagaaagagattgttaaggttactggagatactgaaggtaagcttgataacttggatgcggatactaggaaggctattgaggaggctcagaaggttgactctgatattaagaaactgcaagaggaagagttggagatggagaagattcgttctgctctgcctgatgatgaaagatctcaagcaaattctgatatcttggaaagcattaaacaacaggaagaggtctttgctgataaagtagagaaagctttcttgagtgggaagagcttggatgagttggctagtgtggctgaagttttagacagggttcatggtgcagataaggctggtaacaaccgtcgctttgtacgtgcattgcagactgctgctgaaaacaagaagaagtatggtgataatccagtagcttggtttagtgctgatgattactctgccattgctaaacttggtgcttcttccgcaggtggtaacaaatccagagcactggagaagatctttggttctacagctgaacaggctaagagtaagttgcttggtagggatgatgtagcgaagatgagacgtgtgattgaagataaccctgatattaagattccttcttacaagacaacgaatcgtactgagtacttgcagttcttggagaagtttaatgacgaagggaagcctaagattaaacgtggctcattgtcagagaagcttgaacgcagtaagcgtcaatcgagactccgtgtaagagttcgacctaaggagtgataaaagaaaagccccaaccgaaaggaaggggctttatttgtttctaagttttaaaaaccatcaaattcgtcatacatcccaattctcttcagaagtctggatgttcatcttcaaagcatcctgagatgcctccgtagaaccaatctgatttattgccaagaatgacaacttcttcattcatataccctcctagattgtgtttataaaattagtaagtttctcttcactttcatcaaaagcttttccagctgcttccatctcccaagtatcggcattgtcaataaagctctgagcttctaataggtcgtggattaagtcgaagagtttatttttatctgcttgtgtgatcatgtcagttcctagattaaatcgtaatactgaataatgtcagagagtttgaactctcgaatctcatctttctctacatctatcgctgtcataatccaacaaggtttgccaccgttatgaaaacgggagctagcaacggaggttcggagtggaataacggaccggtcagcaacctcgcctctccaattgcgatagcgaaagcgaagcacttgttgcgtagatttttgaccatcactcatttccttttttgaattgttttcttgcatcattctcttcttttgttttaatcttatgacaagggtctttacacagaacctgaaaaccttctttctcacacagagcacgagagatgatctcatcccaagtggcttcatggtcaagaggaactataggctctatgtggtcaatagccatatcctttacagggtggtcagaaccacacatggcacacttaaagtgcattgccagtctacctgtctttggattaatcttctgctctgtcttggcgtctgctagtgcatcgaacatgggcttccactttctagtcagagaacgaatccctgacttgataaaagaattgtaacgagcttcagtccacattccagagcatctagtcttctcagccttcgccataacctacactcatatcatcttcttcccatacacgtttatctactcggtgtgatactttttcacgtttttctttaatatagcggttgcctaattcgtggctatatttaatacgctgctctttacgagattcacggttggaggagttttcatcatatgaacgataatcaaatttacccattataatatccttattaccaagatttatctaaccatgtccagtcgaacaggtcttccggagtctgaccaacaaagagcagccgagcattctcaagcatcttctcttcatcttcagtatcgaacttcttataatattccattcgtactatatgatacatggtccatctatctgtaacaccagccaacagactagctgctgctttcttccctattccttgacgtcgaagctgaagcttaccaccccacataacctctttacgttccccacatccggggatgttatccgtaccatctccaatcaacatttgatagaagaagttttgccatgaaactaaatcagatacgtaatgaggagggacttctttctgtctttctccacaagcccagcgataatgccatccgggagttatcaacaaatccttgtctctagtacagatgatagtattcttatccctacgttgcctttcagctagtgcatcatcagcctctctcccaaagacctcaatgtattcgtacttggctttaatgtaatcaccaacgttttgccagtgaaaaggtctttctccgggaggtctgtttgccttgtagtcttgttgcttagcaacatcgaaacggaagttaccgccttcgctgaagtagaatacaaccttactacaacccgagcgagctataattgtatcaatcttgtactgaagtcgttcaatcatgaaattgtaatcaactggaacacgtcctgtgtcaaggaagggatgctcctgagtaagagcacccacttcataccgaagaacgtcagcgtccactatagcaacttcagggagcttaacttcttccataaatatcatcctgagcttgagcaataatccaatctaggtctgatactgctgattcaatagttgagtcattaaacagtagatatgtttttctctgttcgccttcaatatacgagcgagaatctctatcaaaagaacaaccatctctaagaacttggacaacttggacattgaaattcttttctagttctcgtacctctgcatcaaagcctccgtcagtgaaaacaataatgtcgtcctgacccagcccttcttgtttgatgctctctacagcaagattccccatatggttgttgccaaacataggttttaagaagtcttcacttgtagaaatcatcaaatctcttacagacttccctccccattctggtctaggcttttctttccattcacgatcttcatagagtgctagaaagttttctagaggcatacccaatgcagcagcagctacattatacatcggctccttgaaagacttggttgaatatccatgatggtatgagtgtgcatttacccaagcactagctatcgtatctttaccacaacccggaggcccattaagaattaccactaaaggtttatattgggagcattccaccatattagtcagtgctggattgccttgagattccatttctaattgctccgtgtggtcatgtgagtagtctactggagaagttttgttaccagtaactttaggtaaaatcgctctagttgtttctacgtatttaccgccatcaatattgatttgaaactctacaagctcattctgtaactcatatcctgataagttggatagctcctccaactcatctctgacgaaatttaaatgtttgattttaattgcaagagctttctttaaaacttttacctcttcattcattcccactctccagtgatttccatatcggctttatctcctttcttagtaaggaggattgctggtttattcttactcttcatatactcaaacatatgcatagagcctcttgactctccatcccagaagactatcactgcatctgcatactcacccatgtctacgtttcgaagtatcccagcttttttaccgagagtgttccacgaaggaatgaaacgtttgataggtatgtcattatgctcagcaacaacctctccgtgaagatctggacctcttgcaccacctgacacaacttctgaaatcagcttggggatttcctctggaagcaaagcccacatctgagtaaaagaatgccagtctatcgaccggcttcctgcgattatcactttcatgtaatcaatccttgaaactcttctttatcgaaatgcttctctaccacatactcatacagatcttttaactccgcataacgacggtagaaagttccgtgtgacattccaatagtcttctgaatgtggtcatgtgggattcccaagaagatcattgagaacatattggctaacttctgagtatccatcgtatcacttaaatcttggaagaaatagaagatacgagactccatgaatggatcaccaacagaatcttgcttatccatagcaatctctaaaggactatccaccatatctggagtacggaacatatcagcctctggaatagagtagatacgacggtcccccacagtctgcctatttgaacgtatagaccagataatattcttgactcgataagtcatatgctcttggtctttctcatcctctaggactctctcatcctgcttagcgaagacaaatctccaagcattcaagagcacttcctgtgccacatcttctgcttcatgataatccctgatatcatacatgaagaacttgtgaaccactttccagttcactttataaaactcttcatagtttgagatgtacttaatagggattccatgaatgcgatatcttgtaggtgttgtcttcttcgccactattctattccacgctctttcagagcttctaacaatccattgtgattagcagcacattctgtgtactggtcctgataccactccaacgtagtggctagtgcctttccttgagcactctctaaaagaggtaggtcaaccctacattcagcttttaggtttgttggtaagggcattgattgcctgctgttgtcgctcgttgaacaagctgacaaactcatcgctagcgcagacattataaaaaactggtttagttttctcataatgcatctctttataaatagtttccgtgttcttcttccagttagataaaccggtaagaaccctctgagcaacttcatcagctgccctacttctttcaatctctaactcttgctggtgcttctctttgtccagattactgctgtctgtttggtactcgttaaacttcataccaccaaagaatacaagagctgagaaaatgataaaccctatattatcacttaatgtactttgcatactgtctccaacgaaaaagccacccgaaggtggctaagctataacaaggagagttatcagaaaggcgaatcgttatcatcttcataagtagaagcaggctctttatcaatcgtaggaattgaaggagtagcttctttctgttctgtttcagaagcacgagtaatttcacgaccagccagaggcatgttcttagcgtcattagcttgagtaagcagattgcgctggaacgggaacatcagttgataagatgctacgttctcgtcggtttcagcatacggttcgaagaataccagaggactacgagcttcaccaactgctgcacgatatttagttgggattggagaaatggtcttgatggagtttttaacttcaccagctttgttagtgtaagagttaaccagaatgttaacaggctgacctaacagaacatccttgaaccaagacagatcacctttcagtgcttgaatacttgggtcaaccatcttgcaaagatcaagaataccagagttcttagctcgtgggtttacatcatagctcttgaactggcaagccggacgtggttctaatgccttaccatcggaatctttaccagtagcatcaacaccaatcagctcgaaagctaaatccatacggaaagccggattcttaggagttactgctttggtcttcgggtcaatccaagggtcacgattgtgaacacccaaacctactacacgaacgatacgtgcttcgtattcaccatcagggattacatcgtagttggatttacgggaagaagttgcgatagttggaatcatagacatagtgtaatttccttatttaatttgaaagattgttgctctctttgagcggttatgtataatatacattacatatatagtgtaggaactaccggaaggtagtaggttttgtccaaacaaaagtctctttagaattatttgttggagattgtctcttataaacccgagactgcctagcagttacataagctctagctttttctgtagctgcatacttatggttaaatttcatggtagtatatctctaagtgctataatgtatataagttatagctgataaagttattgcacgggactgacgacgataaggcgcagacgacaatctctcataagtttgtaagaaattgagagactaccggaagggcaggagccacctgcgagataaaaatagagaattaaggaatccttgatttaggttgtagggactcctagggactttgattctctatttaaaagaatattaattacttattacctaaataattaactaacttacttaaaccaaattcaataagaatagataaaaagattattcctaagaaagctaaaaagtaaaggatataagttaccattcaagtaaacctttaaagttagatttttctactatcctctgataacgaagattagaatcagcttgtttctttaacatctcattatattgatctctgatagagtctttatgtactacaggttctttaaataacgagatcttgttcttttcttctttcatcaaagaccttcctaatctcttgcagagaaacagctttatagttaatttgctccattgatgtacagaaatatctccaatcatcaattacgtggttatgagtatgagcataaatattaaacttccctctcatctcatcagtgtgaataggaatatgagttacccaaaactctttatatttataatcaccagagattctacggaagactttcatcatatcagggagaagttctaacctgtcatggttccctaagactagatgcttctctcctcttacttcagcgatgatatcaagggcatacttttcaaacacccaatcaccggtaaagaagattttatcacgtttagttacatgatcaaatgcagctaggattgctttgtcatgttcttcgatggttttaaattgcttacgaaaactacagatgttgcgatggcctaagtgaccatcccctgcaaaataaacttcagccataaagacctcttagatagtacacccatcacaagttaagtcacctagcagggacagggaaagtaatctggattgctcatcgctgtatagttgatcaatctcttctttaagttttgccaactccataaagttaatgagctgaccatgttcgaggcagtatgtttttagtacgaacaaaacttcagcgttggttgagtcttcacttgagtatttatcaatgtattccatttttatgccacatctccttgtttgttgttaataatatccagtgctgtataagctttacctgttcctaagtattccaaaactggaggactcttcttttcttcagcgactacataaggtgtgatcttccctttcagtacagcctgagatgctttagcactgtcttcagaggtatgaatagtagtaagccctttctttccaattctataagtgtgaacccaaatcattcttcttcctcatattcccaatttctttcataatatccagagttatagtttagggcgcacttctcggcctcttctatgtcgtcggtgtttaggatattcacccaccctccagcttcatcaaaaccttcttcttcctcgttaatccatacactatatttcttcatcgaatcaccaaaggctcttcagagtacacaggagcggctatttctacaggaggtgctgccctaaggtcattaagtcttacgcccttcagcataccgtctaggtggtcctttttggggattccaacagggaagtcatcaatccagatatcgacgaagaagcctaactgtcgacacacctcatccttctgcacaccattacaaaagatgacagggatttgcagggtctctgcatcatagaggatatccacgttatcataaccattaggctctgagaaacggaaagtcacgaatcttacatcatgtccataccctttcatcaatcctatcacatctctccacagtcgtctgtctgctgtgtaagtgtcatcataatctaaaccaatattcatgtcaaaccctttagacaagaaaagccgcccgaaggcagcttcttatttaactgttcactttagcttcaagtgtttcgttttcaatactcaagtcaatcactacaccagtaagctcaacgactgcttggcgaagggcatctttacccatagagtgtacttgagataagaagaaagctttaccttcttcagtggatagggtttcttttaattcagaagcagtcattgatattccttatgttatgttataaattcgcatgattgtaccaccggttagttcaatttcggcaatcttctcatctcgttctaaatctgtatacactagcacattctcaaatacacctgttgcgtcagtataaaggatgttatacttcggaggtggcttacggtagataccttccatcactctttctcctctcgttctttccacagttcagcaagttctaaataaaactcagcttcatcaggacgtccttgttcattacagatggcgctctgacgataacaccaatccgatggcatctcttccacttcaatctccttgttacgaaccaatcaataagaatagttcattcatcttatttattcactctaccaatgcaggtacttctatccttttaactgtgaatgacttgtttggaaactttcgaactagctctgctgctttggttattgctaagttctctgtctcaaagatacacagttgaccatttaatgctacgagagtggagccaccactgtagatggcccaagattgataataaccacgaacactcataactcaccttagtgcgtatgcatccagttaagtccaatctgacaatcagaggccagaggacattccatattcaaatactcaccagccttcttaacacaaagctcggtgtgctctttgagtttctgtacatcgttacgattaactgagaactggccctcgtcgtgcatatcaattaccttagcacaacgaactccatccttctcaatccacttgttaaggaacatcatagcgtatttcataacaacagcaccagcacattgcaggagagtgttaagtgctttatgaaccataactttaccagtggcatctcgtctcattgtaatcttacgaccatcaacaccaatcaagtatccttgagcagctttctctgtcatacgatcaatgaggattgcaatacatgggttctctgccaagaaacgtgctcgcatcactgaaccttcgtcagccccaccacctacaattgagccaagcttagcgtcgccagcaccgtagttgaatgcatagataaacgttttagcattgtcacgagtaggaagaccagcaagtttctggttgtgggagtggatatcaccttcaaggagaatatcacgatacataatagcagaagctaaaccacgttctgccagagctttcttagctgggttgttctcttcaattgcctcagcaagcatatccctacactctttaatgaggtagtgagcgagcatacgaagttcaagtccagaaccatcataccctaagaatacttctttaccagcgggtatgtaatatttgtaagcacctataggtttatctttcttccccggcttacctttctcgtaaattacgttagtaccttttcgtatataacaaccatcaggaacaacgttagtaataacgaaaggacgagagtgatcactgtctgagttatagtcagactcaaacaaactgcgacactcgtgaccaaacagaccacgggagggaatattaaccacgatacgatgtttgaatcgaaaagtcggcgtagcgcagctgttagcttctgccgaaagtttaccatcttcgcgttcctttgctatgagtccactgataagacctagcctgtgagccgctacaacgcgtctcttaagcaaacttccgacactccctagctcaccccctaacccttcttcaagagtctcctcgaggtttgtaggagctgtaggccacttgtttgatgtggctagtgctttcttaatctcatcaaacgttacaggattacggcgattagggttcaaccccaaaccaaatacgtaagccttcatgtaattcttagtcttaaacctgaaatgcttttctaagaacttcttaatatcagcgtcaaccatctcggctgtctgcttctgcttagcattgcctcgcatccaagcagtataccatgcttggtacgttccatactttctcatatctttcttgatttcgaaagtattccaaggcttcttagatacgttaaactctggaggaagaaagccttcatccataagagcttctttaactcgtgcatctttcgatgggtcaaagtctacgtattcgacacaggtgaaagctccaccaatatcttctctcttcagcccaaccctatcacaataggcttgaggccacttctgcaaagctccagacttcttaaacggcttcatataagtagagccatctaatctcatcttaggtaagagaggaatcaactctctgtcaatattaacaataatctctttaaggaggtgaacataccaccgagcatttcttcggttgaaactcactccgtgctttgcttgcttagagattatatcagcgacagtcatctctgtcaaaaatggaagagcgtccgggttgctcactttatactcctttaaattattggtaaagtaaatctgtaaatgcttggttatcttctactacatccaaggatgtggaatcaacagcatatgttctcattgctgcatttgtttgtgcccaagtagattgagaataagaagacctaacttcacgaggctgttctcgtaccagatgagccacaaccctctgattagcaacttcttctctttctctaatagctctctgaatgtaggccagcttcataccccaagcttcttcaaactcttgagggtgtttatcgctgataaccacatactgacgttcaggaataccagagcgaatctctgataataattcatggaacaaatctagttcatgttcagtgagattcatttcgatatcatcccacttgagaactaagaaacggttttggtgtctagctggtaatggcatcctactccacctctacttcaatgtaagttctctcaccgacgtcatcttttaagacccatgacttggcatcttcttcagacttaaaagctttcacaacgctgtaaccaccttcccattcatcaccgaaccagcgctgtcctacgtaaatgtattctttcattactcaaccttttgggagtggcatcaaaaattccatagcagatttaatctcattattgattcgtgaatcacgataagagataaacttacctttgctatcacgtaacatcacatgggttctggctgttttgtgagggagcaatgtgatactagttggaatagcatcaatccctacagcgtatttgtcaatagtcttactttcagccaacagataagaccaagtacgcggtttctgctccgggcggttagggtatgtgtcccgaatttgaaccatagctaacttattcatattaaactcctttagggaatgggatgagattttctactgcaacacggaaagatttttctacgttcttattcttataagagataaattttccatcagctcctcgaaggagtacgttagtgcgagctgtatttgggttttgttgaatcatagaacgaatgatgttctctgaacctctatgcttattggtgaatttccaactgatagttttaccggtacgagttacatcaatgatatttacgatttttacaatagacatatttattacctaagaagtttaatttggtttatataaaagaaaaggccacctgattaggcagcctttgttctagagacgaagccaagtttgatagtcagcttcagtgtaatggttgtttcgagagttgtttttcatttccttgagagtagctctcaggtcaatgttatgctctctccttgttctattcgggtctgtatcttctaatagatgggagtgatcactacaagagtagtgcttatagtggtccctgtatcctctacttggagaatacttggtcattaaagttgcaactctttttacaccctctgctttacagaatttacaataagtgtgaattgtacatctttttgtttctgctgacactataacctctttatgagcttaaagctcctttgcgtgctccagctgcttttccagctcgatcaccacttttgccgccgtttgaacggtttgagctgactgattcaacacgtaagttgcttgacgcattagagcctccagacttgacagctcgtttgtgtccaacgtctttacctctgacagcagcttttccatcgcgcttttcaacgatgcgacgtgcacggtggcgctgagcatctccgctcttgctcccaattcccgtttcaccgcgcttgatcgcagtccttctttcttgtgcatagtctctttttcctacatgatctgccattagatttctcctgattctctttgattaaaggtgtggatggcgtggcaattagcacacaatatcctgcacttcctcatctcttcttttacttgagataaagatctggtgtgccctttggagagttcgaatgacttagttaatggatttaaatgatcaaactgaagagcagatgcgtggcccttaaagccacactcagagcatccatagaatgttttaactctacggataaaagctagttgcctaactcttcttttctcgttatctgcctttctcttatctctatttcctgggtcggcccatctacacgagtcattgcaaaacctctgcattatatacttcgttacaaatggtaccttacaggtttcacattccttgtggtatgttgctatttggacccccttgtgtgaactataagaatcaactctcttctagtataatcctgtacattgcttcctgagcatctttcatatctacatatggaccaagcacctcactatcttttctgatgaaccaatcaccttctttgaatatcagagatacgtgaacatctttattatttgctttgactgctcgcccccatgctgggttatgtcgggataaattatcaatatgacaattatcagtgcgcccatccagatggtgtaaataagattgaggccactggcctgtctctttataccatacggctttcttcaattcaacaatgccacatggtagtcctatgtataggatattaggctgtaagctaaaattataccacttagatgtgaaagggattagaggttcccttttggtgaaaaacatcggcccctctcgaatgtattctagactatctatacacttcaaaatcttttcactataaagcattaactgtttaccttttccatagctttaacaatagctttacagaaaccagaacgaacaatgtcatccgattcgccgtctacaatctcagcgaactcatacagatcatgttcatcaataaagttagtagcccaagtaagaccgctctcacgaccacgcatatcatgctggttagtatcacccatgcagaacagctgagaggtttctcccaatcgagtcatgattgagaaggcttcatctttagtggtgttctggaactcatcaacaataacaatagcatcattgaaagaacgaccacggagatattccagaggtacgaactcgatgttactgttaccgagctggcattcatagaaccccttaccatatcgctgagtaataacatcaatgataggcatcaggtaaggttcaaacttctcacgcattcctcccggaagtaacccaagagagttgcccatgccgacagaagggcgactcagaatgatcttctgaatcttaccgctcttcagtgcatcaataactgtggaagtgattacaaaggtcttaccacagcccgcaggagcgtctgtgaacacaacttgtttagtcttaatagcattgagtagctcagactgaaactggttctgagggactacaggctttgctaaaaccacctcttcatactctcgcttacctttacgagtaacaagtgcttcccgacgaaggtctttccgtgattctttccgtgattgacgacgactcatttacgctctccaatttcttcgtaatgacactcagtagttaagcagtctttacagattgctgtataaaccctgacgttagtaaatcgtttgttctcccctttggttggagagcctttggcaagctctctgataaccttgttacttaaatgaaggtttgttccttcacatttagagcacttcatggttcatatctttatgaatcctgtaaacagctgtcgccatacaagcaacagcctcgttgtgtgggaggtgcatccctgtagaaccatcccaatctttgaactcattgtcaaagactccggtaggctctggatatagagcttgcagctccactagatcattagcaacttgttgccatttatcatcagaccagatagggtcatccaaccagtaatacaaataggaatggatgatcaattgctttctatgccgattgattacttcagcgggacttatctcacttccatttgaagtcctaaatgtattactgtcaatcatttcacaaccttaaatttgaatgttgttgggtgataataatgcaacctattgatagtgtgctttgtttcgagatatatcctgcaagagtggcacatgacatgggtcagaccagttacagggttaggtttgaagttggcgacaggcttctctttcttacagaagctacagactttcttttccatcttttctccagtggtcaacgaattgctgaaacaccttatggtcgaatgtgaaaccacgagcaatcccacactctacgaaagtagaaggcatatagtctacatcatctttagatgtatgaccataaacttgaataagctttttaatcttatccttctctcttcgaggaagcatcctaaatgcctcctgaatatctgtaatatgtttgattttcatcagaaagcctctgatattaactctccaaagttttcttcagagctgcccatgagattgggtagagcttagccatctcttcatctacggatttagcaaacactcgaacttcatattgagcgtgagatgagagtcgctgacgacacaactcaaaccagccatacaaagaaccagtccacacccactcagtgatcatcccctgaggaagaacaaatcgagcttgctctggtgcaataaattcaatcaacttgtcatatgttgctagagaagcttcatatgcatcgttaattaacattaatgcttcagctcgctctccgtcgatgagttgaatccctgaacctgcatggaggtccgaaggtctcgcaaaaatctctttagggatgaagacttcaactgctccatctttataccgccgggacatttcgttccacgagaatccaacctgatgcttgcccaactgtctcgcaattgcgataggtgctttgcatcggaaactgacttgcgggtgtcggaatggagtacagtgtttttcccgtgcaaggaagttgataagttttgtgtctctctcatttaagtcaccttctcgaacaacaccgaaagatactctagctgcattgactacagatttgtcactacccattgcttcaatcagtgttgcttgtagttgttcgttcaattaaaagttccttttttcgattcatgtaaacttgatgagcttcttcggcagttccatacatacctagatgtatatctactttatcaatacaaataacagccctatatctaatagtccctgatttatatttgacaaccttaacaccttgaagccctgtttccttgtttgataccctagccccgaactggttgtggcagtttgtcgaggtgtccaccaatctcaagttctgtattgagttgttcttcttatttctatcgatatggtctatctgagaagaaggccactctccatagtaaaagaaccatgccactttatgagctttgtgtactttccctttaaaccgcagggttatgtacttacttcgagttcctcctaatttcttaccttttcgaaagaactctccagtctcagggatatactctaaatcatcgattaacattcagagctgtatctaaaaatgctttcaggtttgcttcagtctgcataccagagaggctgtagtgtgcaccactgttacggtcaggcacaacgaaagcagggatacttcgtacaccatacttaacagcttgttcacgaccatcaccttcaaggatgttaatctcttccacttctacatcaaactccttaacaaccttctcaaaggtaggagccattgctttacatggagcacactgatcactataaaacttaattactttaggcatgtaaatccttatgcagtcaggaggtgaagcaggaatgggataacaacagctacgataaccatgatagttgatgctgtttgaatctcacctttcttatcaggagtttcttcaataagcttaccagaagcccaataaataccaccaccaataaagatagcccaaataccccatacgattgctgataacatatatctatatccttataaataagttcgccccacctcgggttaggagacagggcggaggtttttagtaagacacgtcaccacttgaatgggacatgttgctcttgacgaagtagcaatacttgccaagaccttcattaatttcttgaagcatactctgatcgacagggtaggtggctaaatcaccatcaaactcatccatcttctcaataatacacatcaaggtcatgcacatatcagagagcataccgtccatgtctagatcagcgttaccctctgagaaccaagcatgagagaggtagttagctgctgtagcatccactttaacacagtggtaacgcatacgttcagcaatacgatctcctacctgtcgtgcgtaatcttccagctcatcaaacataccatgaacaccctgaaatcctgcaccagagacgttccagtggtagtttttagctttgatatgcaagagttccatgttagcttgtaagcagctcaggatgtgttctaggctgtttgcactaatcatgccttgcattgtttcaaggcgagagattgaaagctcagaccggtctaacatactataactgtcacgaccaatctcaggtaaatcaaagacattcttatgcatttgggttttctccatcaagttcaactgaattagcaacattacgtgcaatattatccattacctgctgggtaattacgatgcagttctgtggatctactgacttagaacgccccatttcagggtcatacaccttaactcgcttagcagttgaacctgtaacctgaagaaccttcaacagatatccctgattaccgatagaccaagcaacaacatcacgattcttgataaagcgaccaagcatatcacgatgataaaactgttgcatcaccttggattttgtaatctcttcagtgggcggggccactttactcaaatctaacataactctctcctgtaaaatacaaattcttattgtactctatatacatttgagagttaccatatctactaccaatcagtagtaaattactttagacataaaagaaccagtgttagggtcttcatgccagcgatgtatgtcagcgctttttactattgtgcccagagtcttcaactgtttcttagcaatacgagcctctttgcgagtgtcaaacaatttgatgctatcttttctcatgtgttgctcaagatcccaaacaacatgaatagcccacatctttttcattagtaatgcacctttccgctgatataaacacgaccagaagaatactccttggccttatgaatactgatgctcttagttaagtctacattgaacatagactttttaaaatctcgagcttgttggcgagtgggtagtgcagtcatagtcatgccacctgatgcccacttaatctttgctaaccaaaattgtctcatagtgattggtctcattttactaaactctttaaatattattactatggattataacattaggtctcgataaggcgactagtatcataaccgacatacggagatattagattattctcaggagcagtccctcgacaagcaataacaatatcatatttcccagagccgtgaacttcgtggaagatttcaactgccttatctttttcagtggagaattgtatcggatacacttcacctcttttgtaggggactataacataaagatctactgttttatgcatacctcactgctccatttcactatcgtttgaccaaactaggctgtgatgtttgaattcacctttcagctccttagtatgattactgtcaagttgggtttgtttaacaatcaaccccacatcaaattctgatacagacttctctccttcttctaagttgttgttataaacacttcacagaagctcggtcattttttcattagtcatctatctttcatccacattaaaggataggtgaagcctacttctcatagacttcgctaggagttttgcctcttcaagagttttcactccatatacagactcacgtttaccatctttttgaatagatacacagaatgtcccgcccttctcttggtagacattcttaactcctagtttgttatcaacccttgtcttagcattctgactgttctcagagtgatagcactttctcaggttagtttcttctaggttttctctgttaccatcggcatgatctatttgatattcatccgataaatcctcaccagtataaagaacaaaaagaatcctatgattgtggacatgaactcctcctaagggaatttgataatatccatcttttgtgagcttgccagcaggtttacctactatatcattagcaaacttactaggcttccttttccaagaaagccctgaaggtgatgacatgtctatgttaaagagatcaactacttcatcatagcatatcagcatgatttgttccaccaaaagcttttgttggcccttgttggttattatatgaacctttcgttgcgtagctgtcctcttcggatgaagagtgtttaaagaattccatttgaccaatacgcattcccggtttgatcagcagagagtgatgctgtagaacattcttgaattccatagttaactggctaccatgccaaccgccgtcagcatgaccagcgtgcatgtgctctaagaaacaacgaccaacagtggaccgtagcatgaaatcgcagctaatattatctggcagattgaatgtctccattgtatgagccaagaaacactcacccggtttgatcactaacccttcctctggaatcataacctcattgaagttaggagattctttagcagagatatcaacaaccccgttagctgcaccttccattagaacgcgatctccaatacgaacatcaatgctggaggaattaacagctgagtgtggtgcatcaataacaccatcatcaattaatttatgtaactctggacttcctagtaaactcattcttattccttagttatttgtttccatgtcaaaagagattccacgacccgcttcatcggcaaaccgaactgtacgggtttgaggttctaatacttcagggttgttagcaataaagcgatcagcgagactatctcccaaatcttgttccataccttcatcagtccagataacacgagaaggggcgttgatatcaccaacagcgaaaccctgaccagagaactgacgtgcgctaacagttaagccgtttggtcgaccacgagagggtctagccatccatcgctccatagaatcacttgtaataccaagagcttcttcaaaagatgttctacgagtagggctttctcttcgtgactcttgtgctcgacgcattgcaggggctacaaacaccccttcaattgcattgtgtcggttaggttcctcttctcgaccaagcagatcaccacccgtgttagtcgttaaatttgtcaacccctcagaccaatacgcatgaatctgaccagaaccgtgaagactagacataatctgaatctcttcataagggattccaaagaatcgactcatgtctcggttaacacaatatagagcacttgttgtatcttcaataagagaaacctgacctaatccattgactagatgactaactggctgaggtgtgggaagatatcgagtttgggccatgtattgatgcgcaactgctggagaggaaaatctcaacacttgtgagttaggccacttcttgtgaacatacctgatttcacgactagagacaaccactggacaaggggaagtcatagccaaatatccgtgagaagtcatgaataagttgtcaagagtcatcgcaccacggcacatcataggaaaattatccaatacctcttcaatagaagtaggataattaaacatgaattggatacgaaccccattccactgaaactcaataatatcagtgaatgttaattgagaacccccagcataggattcgtttgtagcttcagcaagaagtgatgcatattcaatatcttgtgactctagccattccttcacattactttcaatctcccgtccaagctcttgccaacgatcagttgggatgaaagtgttttgagttcttggtgtttgtcctctgacaataaagatatcaatgtcatgtggagctatgttattaaggacagcatcacgaacagccccaccagtaatgatgggacagataccatctggaatcaagttgttgttaatcaactgttcaatgaagtgacgaccaacagtgatatcaggttgttgagcaaccttatcttcaatttggttaatcgggataacaatcattttacattttccaatataatgaaggtgggtcgtaagggtcaaatcccgtgagttcacacaagaaaagataaaccttaacagttaagttaacgtcctgttcacaataagtaaacatatcttcagtgaaagcatcccatgcttcctcttgctcaccataatcgcccttaagttctcctaagaactcaccccactgcttcaaaccatgaccccttgggccacgtctagggtcgcctttcggatactcaggactgtcaccaatacggtcaggtttaagatatcgactaagacataaagtgtcgaagacgttaaaacgatagttaatcagattgggatacatcttcttcagagcacaaaggtcgaagtcaataatattgtgacccaccagtacatctgcttctgtaagtttacgaatcccatcttcaatttggtgaggccgatagccccacctttcaccagtttcaacatcgaagatataaatacaccatactttagttatgtcatcgtacagtgcattactctcgatatcgaatgcaaacactttcttctttttctttaccacggtgaagctccatctgcttggttgacgagagaagctgcatcctctccgttagttaaaacgaatggattatcttcatcaacttcaaagtcttccctttctacaagtctcccggtttcactgatatacttagtatagcagacacctgtctgaccgtagttacgttctttcagtaatcgaatgactgagaggttcttagctaagccatcagcttgcttgtcacgctcaaagccaatgatacactgacaccaacgcataagagaacgagagccagtgaactgcacttcacgtacctgtccaccttcttcatgaggagcaccacctgccggagcattaaggtgagatagcacgaaagcggtaaagtctaattctttgcacataccagcaagctcggaagcaatcttactgatttcagtgttaatctctgaaggtgttaaatgggacaccagagcggtaatgttatcaaggatgatgaacttacactggttttcaactacccagaaacggatacactgtttaatgtcttcccattcattctgtccgaagttgtcatacaagaagaatttgtctgcataacgaagtgcttcattacgcaaatcctcctcatcatattcaacatcaggtcggtggaaaggaattgatgccgacttaccagcaatgttcttaacagacatgcctaccttctcttccaagaagaagccacctccattaaaaccatgttctaagcacagatgagcaaccagctcatgagcaatgagtgttttaccactccctactccaccaccaattgctaccacctctccccatcgaataccgaaggtcatctcattcagagtcttccacggatatgggataccccactccgctttcttcagagcatcatcaaggcaatcaaagattgttacagcaccagcaggagattcccgctttgctgagtacttgagaatgttgaataactcttgaccacgaccagacagaagcatgtcattcgcatccttaatctctttctccacaccgttgtatgggaaagttcctttaggaatacgagcaaacttaacatgagggaataaagaacgaccttttgttaaagctatctcacctgcatcatcgttgtccatgcagagcacaacctcctcaaaaccatttacgaagtctcgattacgagacaacacagaagagattgaacctgcaccgaacggtaaagaaacacatgctggtttgatgtttgttgcatttgtaaaagctgtaaggacatggaaacctgacatacaggatagcgggtcttcaaaaatgaacagcttcttgttgtacacatctccacgttgagcttgtgccataccaaacaaatctgcttctttcacactgccgacgtaatagaacttcttactatctagcagcttaacctcataaccaacgatgtttccatcacgttcacgaggaaagaagtagctgtctggtgtctgaccatcagtttgactgagaccaatacgacactcaaaccgctctgatacagctttagggattaaacggcgagtgagttcaccctgaggaagctctaagcaatcatctaagacttctctcaactcttcaggggataactctttcttctcgtttggagtaggtgtagtgcccttttcgaacacttcgtaattcccacaacggttacaacttccccactcctcaccagtctcttcgttacggaagagaatcatgtggttgtgggttttatcacgaccatgagagatacattccttacaacctgtgtctcccaaaatgatctttgacatgctcttcctccttggaatccttgagcttagtagaacgaacgaatttcatcccacacttgttcctgttctttcctataaaaagaaagttgggtcttgaacatctccactgatgattcaaagtttttggtttgtgcagcttcaacgaaacgttcatgtcggttgattttgcaccgtagcattaaatacttggcttcaagtctccgaagagcctgccttttctcaagattcacttttcagatactctgaccagtcgccagattcaaccagaatatcttgttcttcgtcgatatgataaatccaagcgataacagtttcacctgagtccatcttaacagcaatctgagtacgctgatagaagctgtcttcagggctacgtttgttgtaaccttccagacggtcatacggaccttccagacctgctttgtcagtagcaaacacttctacacgaacaggcttattgttattgctgtgtgcgagagagatgctcgggaagtaggaaccaccgtaacggaacagatcgaagttgtcttcagtccaaccttcaccaattgacttagcaccagctcggtcattaactaaatagttagcttgaccacgacgaagagaaccataagttgctacgtaaattacttctgacattatctatacctttgttggtttgtttagtttatccgaactagcctcatctttcgaagaggctaaagcagattactctgtaataaagattttgattacaccgcagattgctgcactttcaaacactgcaacagcttcacttccttgaaagaaggccactttgccatcagagaagttaaacatgtcagcatcgaggtccattgctcgcatctcaccagctgcattggtatctttaaacagaactttatacttattcacagatatgttactcccttgtcttgttgtgcttcagtgatgatacgctctacacattccatagagtacttatcaccacgttttaggaaagttacaattgcagagaattgattaccaatcattcgctgattagtaatacccaactcctcacacaatttacgcaactctttacgagagcctacaataagaggctctttttgttccatcattccattttgtactagatcttccaatgaaaacatatccatatatccttagtagtttacaacagtgccatcattcagggtaaggttattaatctgcaacacacgaccaagctgacgatcactaattggtgcgttccatccagagcggtagaagttacgaccacagaagaacaagatcacattacttgctacagttgaaccattttcaggatgcttgatgttagcgatataataaccacgacgcagattacgacgggttacagggttgatctctaacccttgctcttcaacctgcattatttcagggacaggctccgaagactcttcaacaactggctcggagctttccgctgatagtgcgtaatcctcatcacctgctggtgaaaatgtttcttccacttcttccacgggaagttcgtatgcaacacggtagtcaggctcaacaccagagaagctcttaacaaactcaacgatgttgtgagtgtaggtttccagagttgtgccagtcaggcccggagctgtattaacttccagaacccaagcgttagtacctttgctaatcaggtcaacagcaccgaagttcaaacccagagcagatacagctttgtgagcttgaatcagaacttgatcaggaggcgcttcagtgaaggagttagaataaacccaaccagtatgatggttacgaatatcttcacgatagctttccagttcacgataaccattacgacgaatcttcttctgaacgtaagtgataacaccttcgaacacatgaacacgccattcacgacgtgggccttggatgcctttggtgtacagaggagcatccgcaacaccttctcgcggaagacgaacagtgatcccctcaccagagtgaccagtcaaggttgcacgttcataaacaatttcattccggttccagttctgagctacttcacgatctacggtgtattcaacagttttgacttcagctaaacgcagtgcgttaaatgctgcaactttgttagcggctcggttcaaggcaaccacagagttcaatacagttgcaccgccaaagaaagaatcattatatcgacggtttccgtagttgacaacaatatcaccaactcgagaacgataacgagaaccctctgataccagagacattacgttagcatttagtcgaagttcctgaatcttagtgttaattgcagaagtaagttcacgaactgaatcagaagggccataaggaagaacacggatacgagtagtcattgttagatacctttaagtttaagaatttcgttacgagttttttgaatctgagcttcaatttcgaagtagtcattgaacgcatcgttctctacttcatcggatggtgcatcaatcagaccgaaagcgaacggatacagctttcgctgctccgttaccaattcgatatgaactcctatgtaatactgtaggagagtaatcttcggtttcttaggaaccagatttgacatgaggttctaccttaatgcctttgatttttacataatcagcaagcacgttgttgatcaccgttgggaaaggaacctcaacctgtgtttcaagtacttgaccaataccagcttgcatccacttctggattgcacgaaggttatcacatcctgtgctcgtcatcgggatacgtcgagtagttacaacgttatccagcatcatcttacgaatttccatacttaacctctattcaatgaacatttaggagaattacaataaacttgattcatagaaccaagcgtacaactttcagcatcgcgccacggaatctgcttaaaacactctgagcagtatccgagggttgaccacattgctttggtgaagtcagtgcttcggtttccgtcgaagctgacgacagttttgcggagagctgttcgtgattcaggaaacacacctgctttctcagcaggttcctccttttttggcttagttgagattgcaaaaatactgttgctacgtttctcaacataagcatcaacaacatcctccagagtgatgcctgtctgtttcgctgaggaaggtaatacagtcatacgaccgatcatatcttcagttacacgtaaagcgaattcaggacgacgggcgtttgttgtatctgttgctttaatccagacataaccatctttgatcgtagcattagacactttcttctttacttctacagcgcagactttacagatatcttcaccacgaagacgactaagttcatcatcgaactcattctctgttttaacttcaccgcagatttcacaaacaccaataggagtttcctcctcttcttcctctttaggtttagtcaaaccttccagacattcaggatgccaatagcactgatatgcgaagactgctttaggtgcatccttccaatcaatgtgcttatcacaaccaccacaatcaccatgagagtgcgcttcccagaatttacgagtgatagtaacaccattcttgttgacgaaactatcattcatatcaaaagggatatcatcatcgaagtcagcagtagttgactcaggctcctttttctccagagatgggtcaacaaaacgacctgctgtgatcactaaacggaccatagcattgacttcggagatgcaggatactgtcccacggtaaacaattttagggtctttcagggcatcctgataagccttaatgtctacgttatgaacatcaccttcgatatactcttgagatttctcatcgtagatataaccaatcatcttaccacgagaaggaacagcaccggcagttgcataaggaacaaactcatgcggagtgatttccacagtcatatcgcggcgaatatcaatgtttcgatcgcttgcgattttgttttgacttaccactgcgtttcttcgacgaacgtctgccgctgtcacacccggcttcgtgtcgtaaggattgcttgtactgctttttgaggaactttgatagttgctttggctgtaattgttcgagtagtaattgccccaacgattgactaccgtaaaaaccggaagctcgtgggcgacctcttcaaccagtgtcatgctgttattagacatgtcaaagatatactctgtaccaactttacactcaaaatgctcatcaatacggttcttgtgagacttcgaacgcttcagaatccacatcagcatatcttcttcagaagcgccaaaccaatctctgttacaacgtgcgagatggaaaggacgctcttcgttacgaatgatatgaaggcggttatcagaagcatcatgccagattaaggtgaaagcaccatccagcttttgaatagtctctgctgcaccaatagtgttaatagagtggcagatgttctcactatctacctcgaagtttttactgtcaggtaacaggtcttggtccatcaaggttccattatgaaccagagtgatgttaccatgttggaaaggatgggcgttcttggcgttaactgcacctttcgttgcatgacggctgtgaccaacaatccatgaaggtgctacagtgtaagctgtttcaccagtggtgtgcttcttgtactcatcttgtaggatgaatgcgaaagaaggaagagcttctttataagtgaagacttccttagtacttttacgctgaccaaagataccggaggaatgttgtcctcggaatactccagcataaaagagttggttaaatacgtctaaatcagtgcttgacagattaccgccagctaatacgatgccacaaattttctaatccacctgaagggtaaaccctttcatctaattaacctttaaattgtgcccctttatcagaggcacccattgattacagcgcttgctctaactgattttccagatggtctggaatgtaccctgtgatattgctatcactgtgacctgactcacgtagtaagtcaaaaatagcacggatacgctgttctggagcgtgtcttacttgagataggtctgctgtacgaagcataaccaaaatctcttggtacaagttgttagcgttccctcggacatacccaaggaagccatagaagtctgacataagacgtaagtcaacaagagcctctccgttggagttggttcgacgtaaacgaatacgaccagactgttctacttcatgagaacggcaatacaaaacatcacgggccatacaatatcctgaatgcaaatcagattcatccagattgtaatccagaggaaggtaaggaagcattggggcaaatcgtacagtatttaagtgctcaataaactgatcattgctcatatctgcgttatctaaagccagcttcttcaacatcaagaagcggttaaccagattgagaagttgaccacgtttccacttaggctcactgatacggaactcaattgaaccgtattgggcaagtggcagaaggttcagagatgtatatttatcccatgaacgaaccagacggttgaagaattcttcaccatcgtagttaaatgcgtcagaggcattcattacctgtgcttgtaccactgcaaacgcagggcagaaattgctacggtaacgatggtagcctgaacacttgaacagcatcttttcatagaaggtccaagcaaggatggtcttcttgaggatattactatcagcatccctcatatccatatgaacgtgagtagagcaacgccaagtcccctcggcgtgcgattcagctactgcttcactcaggttgttgatagcgtctaacaactcctgtccgttgtaaggtcgtgaacataccatttcacaaccgttacgcagggaaccatcctctgtgcaatcccacatatctgcttcgatatgttcagaaccttcgagttcaagttcaataccgacaccgcactgaagtgcaattgaactatgcgcctcagttaaacgaccttctcgatatccaaaagtttgcgctacagttgtcataacgaatccaccaacgtaatattataattgctaaggttttcagagatgtgatgaaaatgctccagaagtcgcatcggttgttgaccataagagtcacgaggtgcttccagatctacctgacctaccagtgcacctttataatgcactttaccatctgtaggattgatgtaaatataacgagtaaccaatccatcaaattcaggattgaacagactgtaaaccatttcaccagagatcgaacgaccaattccaggagcgtttcgaatcttgttacccatcaaacccttcgctctctgacgaacagggttgatatgagtccagcttacagtgttaccgttatggaacagataaccaacatcaggtgattcaagaatcaaggttgggtcgaacactggaatattcatcgtagtgtttcggagattcccatgctcgttcttgtaccactgctctacaacaaaatacagagcctgttctgcttcatgcgagaagtcatcgctgcggaagttaccgctctgctcaacaccaatcacaaaacacggaaggttgatattgcctgctcgtttagcaatccatgtaccattatagtaatgagaaaaatcagctactaagctcacgataacctcttatgctacctgaaggagtttgatctgctggtcagcttctttaacgttgttcccgttaatgatttcatgaagcttctcaatcggaaggcgagagtgcaatgccatcagggtggacatatcacactgctgaacaaccttgtcaacctgatcgtaaacaaacttacggttttcacgatcactaatccagaagttagacagagaacggtattcaataccatagtctttataacggattgcagatgctttaccgtagagttctttacggcgagtatctttgtccataattactgctgggagagacaggaagtagtcacacaacacacccagcatcatctgagtttgcagagtgatatccaaagcaccaactacgccaagatgtacgtgaccaccggcagtacgaagtcccttattctgagaagtcggggatgggtttttctgaccagtgaaggcgttgaaatcaggagtgcacccgaagatgaacgctgattcattaaaggtcttcatttcttcttcggtgaagatgtgagagctaacacccggagctgtttccatgtccagtttgttcaggacattattggtaagatcgataccacgttgcatgttatcgttaaacgcttcaaaaccgctctgtgggtcgatatcaaactcagccagtacgttgtcctcttgaagacgaacatctttagccagagtgatcttatcgtccttagaacagcctaatagaccagctacagaggtgatgataccattactggtacgaacgaacatttcagggtcagagccgataaggaatttgcgcttagtcattgtaatactccactagttcagaaaagagagatgagattgtgttaccaacttcttcaggagtaagaccggaatcttctccagttctttgaatcagtcgggctataaagttttgtactgtaatgtttcccaacttgtcgtctatggtttcacgtttatgaccatgacaagtggaccagagtcttagccactctgacattgttgcatattcagctgggtcttgatctttagcaagagcaaatcttcgtaaggtctctgggttatggttacgaacatagccgttctcattgtaaccaacaccaaaagggttttgaacccatacttgattcgtgtattcatcagagtctacaaccaaaggaaggaatgctgatgctggcatattgtagttaataacaatagatgtgctctcactgctcccattggatcttccttgttgagtccaccctccaaagaagtcacgacccaacccagctaacactagagcgatgccgatgcgtttacgcttcagccactcttccctgtcttcaattccttctgctaggaaatccattccacgatactgcccttccagaatgctacggaagagcataagtcctgtgaagatctgatctgctggatgctcacgaaggttgacagcaacactattcgctgaagtgatcgtaaatacgtcacgatagcaagacatggagttcataatgtctgctgtttcaactaagttcttttcgatatcagatgtaacatgaccgtgaaaagagtgagtccagtaattcaacatctccagttgcaagttgatatcacggttgaagctacgatagcgcccttcttccgtgataacttcaccattaatgtcatttacccactggccttgcatgtggttgtggataccgaagcacccacgacctaagaacttctgttcccctaaatcctgttgaagattcagaggtacgatcgttgtggagattgacataactaaccttttattttcctaaaaataatccgctcataacaccatcccactcagaggatggaatcactgaatactccgaactttggtccagagtcccactactaaatcgctgaataatgttgtagatgttgaacaggtctttagcctcggcacgaatgccgtagattaacctgttagctgttctctcatttttagacacgcgacgggtaaagttaatcagaaggttgtcacatttcaggatttccgattcactctctactaagtcggggtgcatcaccggcaagaacatcgagttattaactcgtaattctgctgtttcatcattctcataatgaatccacttaaaatcttcatcacggaaatgaccgcatccatccctatacgactgttgacgccaaggcacttgaaatgcttcagcatatttatcagccataccaactgtaaacagtgacgctgggaagatacaagcatcccaatcattaccgaccagagttgctttcgtttcgcccaagaggttggtgtaggtgctaaccattcgtgagtaaacgtaagcctgaaggattgtccagccttcaaccaaccatttatgaaggaaggtttccacttggctctcttcatcttcacaatagaaggttcggtctaacatcaaatagaacagacaacgatcagcagggatattctcagttgctacccccataaaacctttatcgtgccagcgtaaacaggagggacgatctttgtccacaaatgcttccatagcttccagtacagcacgaggtgtggttcgatgctcagggtttttgtcgttccaacgttcgatgttgttcttaggtggcgtgtcttcatcttcatacgaacaccaacttaaagcttcagctacatgcttttcatcacgccaacgtctaaaacctaacatcttcatatgagttccagagttccagatatgcttgattttacacatatccatctctcggcttaacaggaactcttccccatcagcactacgaacgttagcttcttcatgccacactcgaacgtgcatattccatccatgagttgcctcatacatgttagggtcgaagtagtcatcgtactcttcatcgtcttcatcaacgccaccgttatagttgcgaagctgaaggaacccataacaaggagggttgactgttaaaacattaccttcagtatcttctaatgttactggaaacattataccaacctctattggtttttaatcaactcaatcgacttacgaatataaagaatatctcggaagtttcgatagttgttcataaattgatgcttctggaactcagcttcttccagagctttctttgcttctgcgtagtttttacgggcaagatgtacaacccgctccggtaacacgtttgcacgatggattagatacttatgagctttcatgttactttgctcacgagcaatcttacctttagcaaccttgataccatttgcaatccaagcaagttcttgctcaagctcttcgttggacataccaccgaggtttgatgcaaccttgttcagagtttcaatattaacgttgcccttgatgggacgtgtattcatacttactcctgttgtttacactcgtcaataacccactgataagtggattgcccagaaaagaaacactgaataaatccagatgttctctgcgttaccagtgctagtgcacaaatcactaccgctgctgctagcagttttaaatctaatttagacatatttcctctcgttgaatttaaaaaaggactctccgaaaagagtcaagctttaaatacaaaaagatattacccaatatctgtggataacctgctcttaaaatatctatccgacggatgttcgaggaatgttcctctccctagcatcggccccatacgggaaatatattaagattaggttagttgagtcagaataactcacatagccctccgaagaaggctataggcgttactacaactaaaaatcacttgattttacaaaatcatcactaaggatttcgtcaatttctttgttagtcaagtctttcctgaaccaacaacaaggtacatccacccattgaccagagttgttttctacagagcatctattgcctgtcttactcttgcacttataggtcttacctttgtctagacggtagtgtattctgtaaacgatcgacacaagtgttatcattactcgcctttcttagcacgatctttggcagttttgccagtgcggatgcgatgagaaacgttaaccagagtgccaccatcaactacggtaacgctcttgtttttagccagatcgaacacagttttctctgtgccacccaagcgaatttgcttaggttcgctgaaggtttgggttgatttggattggaactggaacggttgacggattgcatcaattgcacttactttagacataggggaaattccttaaaaagtcatggctgcgtagagggaattccctacgcaaattgggccgcccacagagaggcgtcatagtactaaaaggaggagagaagagggcttatttagctacctttttctgtccgtttacaaaccagataattgaaccgtcaggctggcgttgaccgaagcctttctggttgatcatatcatcataagaatatgcttttgttttcacttacttacccttacatcggagttaagatgatctctgctttggcaaacttctcgccaacttcaagagtgtcagaaacaggacgaggttcgcctgtacctaaattaactgctctgcgatatccaccagatagaggcatcatcaaataaatgacctgactgtcatcatcttttaaagtaaagatgtcagcggttgacagatctttaacaaagagtttctttttttctttgttgtgaaccttaatatgtatcgtgctcattctcactcctgaaccacagacatacgaatcatttctacctgatcatcaagacctttaacagatagtacacctgtggatagattcactacaggaacccagccactggctatacggatgttaccagaagcattttcaaccctcatataatactgaggagaggcacttccgtgctgaaccatgaaggggtttccgggaatgattgtttccaatcgaaccgtattatcctttttctttgggatgattttcattatgtattatccaccaaaagttctgccgacacaggaataactcgacaataaatagaaggtgctgttacattgccatcagacagacgaagagtgattgatctgtcagagttgatagtaacgtttggacttgcagacacagaccctttgacatacagggttgcattgtcaggaaacttaaacacagctccgctgggaagtgagttgaggtcaactgtagtcacttcttctttcttgtgagtaatcttcatattatttaccctgaataataagtttagattcgaacagatcaacagtattggacaaagggacaggaaagaaaatatctttagggttccgaacacacattgcagaatgctcccctgtttttatccagaatttagggactacatcgtcaccagtaaaacgaaaaacatctccattctccaagtcagagaaagtcttggagggtgttttgctttttggtactagctcaaaattcatcttgattcctatttaagtttgaggctaatgttaaggtgcatacatgctctgttctgtacagcagcataacttctaccgagcatgtcagccattctctgaatagacatgaacccagcattacggataaggaactggtcctcttcttcagaccatttaactcggattgaagctcttgatatgccgaatttagtgcaagctgtgttaacagcattctccgttacattcataatctgagctacttcttgaaccgagtactctttgattagtctccgaagattttcaatctgcatcggagtccatatagttcttcgtgctttcatacatcctccaattaattgttaaaactatcaggggagaacactagctctgggccacgctgtagatatcggcctaccttccacagctaatcagctaatatactcccctaatagtttatgaatagggggaggggacgaatcctcccttatcctattagttaatattgcatgtaagatctaacaatcggttgcctttgtaggaataagcgtaaagccaatccagcactaaactcccgcccccttagtgggctgggttattaaagggtaacgcccttatgggctagttacatgaatgttagtttgataggagatctgaagtcctatctcaaaggactctcgtaagaatccttcacgatattacttattcatctctcgtcggctatctctccaagccaaccaagtgtaggttttcagttcttcaaagtcttctggagagaatagatactctttgaaggtatcaccaaaccactttaaaaattctttagtcatgagtcctcatactttttgttaggaaggatgaaatcccaaagagcagcccatactgcgagagatataaacagtacagcaatgataggccataggaaaaccatggctgctatctttgcaaggtctgcttcacccctccagtttctaaagcattcatcacctttaacatctataaccttaataagtactcctgataacaccatacctatcaggtaggttattaacatactaacaagactgatcacaaggctgatctccacatgttttacagatcactggtgagtaactacaggcaggatatactgacaccccatcaaacgtctcacatccacaatcaggacatgtaccgttggattccatgtcatcatcgtcatctacttcaccgccaccaaaacaactcatacagactccctaataaactaaacctacagcctttgcatcaggttgagggactacctttgcgctagggcgataaccatccactgaaccgttccaaagattgacacaggtgatatatccatcgtctatgatgtctgttttaatccagaagtgtttatcatgaccaaaaatacttccgtttggcagcgtggacagctcaacggttttaagggactgcttagagtctagtttcataataacctcaattatcgtagcatgtattccaatacatgtagttaacgtacgttctcggtttgattccgtacatgatgaagtgagtcttcttaatcctttccttcagcgtgtaataaaggccatcactgaagttaccaatctttacttggaagcgtaaggagcgagcatccattcgaagcatagagattaactgtactctactacccccagccatctcttcaagaagcttctttgtattccaataatgagctgccatattaccactccttaccggttgttgttacagagccaccacaccactgcgcatcggataaggttttagtctcctcatctactgctgcaccattcagacatgagataccattgtaacgcatatcaatttcaccagaaggaaccttctcacctttatgccagcgagaaacacaaacaccttccactgctactgcacaccatccatcaggacggctctgtacgcagcctgtaagggccacacagacaaggaagatacagattaaggatattacaccaccccaactcatggctacctcctatttgatttggcgcaccctacaggattcgaacctgtaaccgacggattagaaatccgatgttctgtccaattgaactaagggcgcggaattatttagatcatatctcgcttggtgatatgaccacatgttttgcactgcatgatatagcgtacacctttatgtttcgtaccaccataatcatcagtgatctttagtgtatacttctcaagaattacccaatcatgcagatggaatagacgtttaaaccacttgaacataataacctcaagcgcaagcagggagagtgatgattttatacttgccttcaaactctccaaataaacccaagaatgtaggactgtaagtaccagtacaaacaaactcatcaaacaatgcgttataactaggcttgatcttccaagcccatacataacccatcttgtcaattgcaatgtaacgagtgttcagaggaacagtcatcattataccatcaacttcgatcactttagtgattggtgcagcttggaagtttttcatactttacctttgataaaaatgtcattaccacagacacagcatgaacgaacaacagtagcgccacgctgaacgatacggacctcttccttaaccagattaacacgagcaccacagcaaggagagttgacataagagtaaccagcttgtgtattcttgattgtttgcttagacatttgagcttcctcttgttagtttaggtaaaccaccccaatcactgctgcactcattcatgtggaatgcagatgggaaaagtaattaaaggtgatttacctaaaacaacaaaggccacccgaaggcagccttttatttattaactgttatacgtccaaccaccttgcttgttacggatggctgacattgcatgaatccaaaagccttccagtttcagagcaccattagctactgcatccatacgttcagggcggttcatacgtttggttgatactttcatacctatctctctttgttagtggaggcattattgccagttgatataagggatagccctagtcagtagactaatcctgaccgcgtactcattgccgaccttctctgcctaagagttcaggttctagagctatctcttattccaactggtgaagactccctacccctaggaagtctcctgaatcccaaactaatacgtacccctacatatcagaaagtctttcgaaaattaacaggttttagtctagcaccggatgttcgagcaagctctccctagcggtgtggcatatgcctgaattaataagttaatgaggaacaccctcacatagccctctgataaacacaagggctataagtcgatgttacttttgagtcaaacacagatcgggacgtggcataacagtggttgatagaccgaagacttcaacataaccgctgctcaagttagcagccttacgcaaaccgtcagaggtcttatcttctagcatcagccagaaacgtttatcgtaagagaaaacatcaccgcccttaacatcttctgcatttgcatatttaggataatcaactactttaatttccattcacttacctttattagtaattactgcatctgggataaggattacaggaagatttgaattaagcttcataacctgattagttcttaaaccaagcacaactgttccagaatctttcctgttcgactcggttacgtgtggagtgaataaactaacaaccaaatagtgatcgacgcatgtagatttaacttggaatacatctccaagctttaaatcacccactgtaagatctgggtctttcatctcaagatcaatcttcatctttagcctctatgttggttatgtgaagatcactacgtacttggcagacttcatcccgtttaaaaggcatgagctttccagttaccacatcaacacagttgacataattgtctgcgtacaatgtgtcggttctgatgtaaagggattctttacgctcaaacagaacccccggcttcatgttatttaagcgaagcattgtacgatcggatttaatattaactttcatctttaatccaccttattggtaagtcgagcattatcaactacctgaacaacagtatcttttctcaacattgttattctatccgaagtgagatctactactactctttcgtcaggcttccaactagctgaataaacggttgaggaatctagctttactgtaagatatattttatttttaggtggaacagtttcaaaaacactccccaccttcaggtctttcagttgcttgactacaggggctgtattaatatcatgcttcattgttaatctcctgctgtttagcaatagccactcgcaagtcttcattagcacgagcaaggcgtaacacttcgtggttgaggttctgaagacgcttgtttctgtcctctacttgcataataagatcgttaagtgttactttaactttctcattatacatctcatccactcgaactagggatttatacattctttcccagcttgctgctttgtttctgagaacaataaatcctagaacactgatagttaaacagcttacaaaaaggaatttatatacttctaaagtcatattatttaccctttatcagagattaaaagtaatattatttaagtaagttatatttagtaaacttattttctaagaaattttcaaagggtctatatacagagcattacccatagtcccagaatactaccatctttttcaataaatttactaagtggttggtttataaaggaatttagtttgtcaaatctggcactagtgattattccctagagctgttatcgaacactaaatcaccacaatacataggattggcataccattttggcaccccttcgctcttactctgaaagtaagtcccactatacagcggaacataattcttcttaagggcacgtttagctagccgctcgctttctccaatggcttgcttagtcatcggatttttatcacgaatcagctttacataacgcttataaggtttctcctgttttaatagtaccggaatccactcaaactggttcttttgtcttatcacctgttcagcggtcagttttcgttgggccattctatttatcacggtatccgcaactaacgccttacatgcggttggctgattccctgcctcataataaatagtcaatgtcaacattagctgtgccgttgttatcagaacttgatacctcctgttttacgggcataaaaaagccccagccgtagccggggcaaacctgaaagcaacacatgaccgttgctataaatacactcgcaaatgcacttacagcaacgcaaaaagccgctcaaaggcggctatgcggaagcttcaaatggggagagggcacgacgctacagaaagagcgtcatagtactaaaagagggggctatattcctactacttaacccttgcctctttgatggggtcaatgtatttttcaacgccccacttgtgtttactatctgcgtagaaaacatcaggtgcacattggcttgttttagggaaggcttgcgggtctttcgtgctccccttaaacttctgtttacctcgagtgcgaccattacagaagatttctaacttcttctcttcttctgttttagctcccccgctctgtaacaaagaacgtttatgatcagccaacaacaacgcatcagcccgatggacacgatggcctacacgctttgccacactggaaggaacatgggattcagcctcagcctttgcagcacgacgttttaaactacgcttactaacgtgattagttgccttcggtttctctttctctagttcagagatagcaaaacaacgaccgcccttcatgctgattttagatttagccacaatcttattcctttcagtgataagttatatcgggcaagcccatcaaggcgataggcttgaacaaataacttaatcaagtaaactaaacgatttccaactacgtagaaggattgtaccgtcatccatagttacacataattttagtagtttcttattggcactactcaccgttgtaattcgtccggttgtacatttacctttattgctataaagatatacaacacgacggcctaacaagcgggaaggtgctttcttaaactctgaaatgttagtgatcatgatgcttgatacctttgaatgtgttcaatacgggttgattgagcaaatgacgctttaacagccattttcctaacttcttctttacgctggttagtgtgtacagtatcccaatgattgttatcacgttggcgctgtaatatcttactacatttgcgatggtttcccgtgctgcgatgtttctcacaaataggacacttgccaaaattactactgaatatcattttctcaatcccagctttcttaagatacggcctaacgttgtttcttgcgtgataatataactgatcgcttcacgttccagcgtttcaatcttcattggcgacggataccattcaccggtaataacacatttacattcaacgccatactttttagatagtcggtaatgttgaccgttgacaagattcctatagatcgtggtatgtgtaattaacatgatcgtcacctttaattagattctttgattaatgcactgaatcaatgcactgataaaagaaaaggcgctacccgttaagatagcgccttatgtttatttaaattgtattacttatgccgcttgacgtgccgccataatttcagccgctttacgcaatacttcttcctcttctgctttcgccgcttgttcgctacgggtagcaaccgttgaagagatacgaccgcgcagactttctaacttctcctgcatagctgcaacagtcttttccatttcatcagcgtatgaatcgagtgattctaattccttgcttgatgcgttcatcagataatcatccgagatcgctaccgtcgaggccgtgattttcttgatgagtgaatcaaaggactttttaaccttcccaacttcttcactcagggcgatagtgttatcgctggttgcgccgttgcgctcatcagccagtaatttggcttcaatacggattgcattcaagcgttcaaccaaagcataaatatcctgattaaaatcttccttgtttttcgccggaatttgcaggtgtgccgccacgttgtcattgcaacctttgtagaagttaggattatccacttcaattgcacgacctaatgcaaagttttcgaaagcatttgaccagcgagcgcggttttgttccattttggttttaatttgcgcttctttcgcatcttctttagctttcgcctcaccttccagattaatccactttttacgaccatttgccgcatcggtgttaaacttgataggagttaagaaagtaattgcggtagcgataacatccatatcacggaaacgttcagttaacaggaagtcaaccgccgcctgcaatacatctaacttcttaccgttgctacgaaagtgctgcaaatgccctaacaggaagttagaaacatcttgtttgatcgccgcgttattactgcgaatgttgttagccagagcattaaaaccggattcgttaaccagagtaaagattttagccataatattcacctttcaattgtaagggcgctattgccccgctctctatgagcttgtttaagtcactattaacttaactataaccactcgttgttaagtagttataggtaagcggggcggtcttatcaggagttaaccttgccgcccccttatccgtgatgtttcatctggtatctttaattagtcgctataaacgaagccgacctgatagcgatgatcaatcatcacaataaggctatgcgtccgactctatttaattacattgctgtaaccgtcggcaatatcgtctactttgttttcgctcccgcttatccttttgtatcagctctctatcgctagtcatcgcccactacgggatactattgcgaaagagtcactaaccgcctaatattccggcgttttatatctttcagcaggtttactacataacccggctatgtactttcatcctatgatgaatctcaagccgttcacatcgtaaacgttcgcattaaaccttattgttaaatagcaatttgccactttttaaccactccccgccgctctcaattgagcgttaattcgtcggacttgcctaccctgattaacttctttcactgtagcaccgtgttagcaatgaccgccgctacccttaaccgtgggcgattagctcaagtctttgcgtgtactcaatgaatccgtttatcaatggtgacgtttccagtaagggaatgtaaaactgtttaccctgataatttagggagttttacgccgttttatctggtatgctttccgatggttattatcatcaagcatattcaaccgatataggagaatgtttaaattattaaagagcggtaaatctatcagtgtgctttctcacactatgcaactgttagccgttgttacgcttttcactgaagcgatgatttgcttagtgagtgctcattatgaatcatgttgttttcgctgtcaaccgctttttaatcttttttcgtcgttcccgctattgggaggatatatcaatcagctttgtttgattgaagattaagcggtgaggcttaacttatgattcatattgttaaagagcgtttttagccttttatagtgtctgctaatcactgcatcattgaaggcttactgattcattaacaggacgcctaaccctgaactactcgctgcactatgtgccacctttcccgcgatacgttgatttgggaacttgttagcggtgtatctgctaacttgtggttagtatggactactttaaccacgtttgcaactctttttatcatcttcttttaattcctttcccttatctcgcgtgaatctatgcgaaagggcaagatgataagtttttaaagagcgggattttttaagtcatcgctgactatgctcactatatgtcaggctgttttcggtgtcaatactctttttgagaatattttcactttctagcctgatttttaaagagcggggcaatttcttgccttgtatgttttacatcgtacccgatgaaatgaagtatacgctaatcagatgaggttgcaatagggtaaagcaaattattttaaactttttcactataggaaggtaaaagagcaggcgcacgcgatacatcatagaaaatggcttgtaaagcgatatttagcggcctaaaacgcatcacaacgagctaaaagggagtaaggcatacaatcacctcataaaagagaaaagcctcactaggaggcttacaggaaggattagagaatcagataaattatgaccataggcatgactacggcacaatacaggagaaagattaagcctatggatttacacattgaccgttaccggatgccatttcattcatggactcatcaaagagcgtcaacgatgagcgcatcaagtgatctaccgtgatttgcttaccagtggtttcatttaccagttgaatagttttatcgtatgattgtacatgttcgaaatcattcacatgtaaaataataactttaggtgactttttaccagtttcgtaattctctacgagataggtacactgtaaaccgtcaaccgtatcaggggagaatgttgcagcctttacactacccatatccgatagcaggacacctaacaggagaacaaccagaaagaagcctacaaccgttttaacgacgaatttaataaaccacatagccaatcaacctttaataatgagattaagcacatcgagagcggcaacaatcagtaagtaatttaaagaaatgaagcccacgacaaacaaaaacaaaaacagcacatccagaccttagaaaacgtaagaatacagcatatcagtaatgaacagcaggaaggtcgcaccaaacaagcaacgccaaaaataatcactattcatcgttgctattctcgccaaaaaatgctacgctaatctgttccacttcttccagcgacaggagaatcccgcgttgggctaaatacttcccaacggttatataatcttgcactaaacagacaataggaaagcgtatattttgaatctcacctttggaaagaaaagacaaatatccaacgtcgattgattcatcaaaggacaatgtaacgccaccgtaattatgcgtatcaattaacgcaatagtttcatttcccattggtatcatccccaatcagaccatgattaagcaggttagccagcgacaaatcaccgtcaatatagattgatctgaaatcatcgcgggtaatttcgaaatcagcaaaggctagccaatctttaagaggctgatattccatcctgcaaaaagtgataacaggcaagattatctgaccatcaagtgtattaaacaggatagagcttccaccaacaaaacaagaaaagccattagataacttaatttctttgatagccatttttacactcccaaaataggttattttacttactagccttaatgcagttggctaaattaacgtgaacggtataaacagcgttatcagcgttattgtaaatagtcgtggcgatcatcgactcattgatcgggccatagctcacaagattagtaacggctttaacgtcttcataacgtcgtacagtgccataagtaaccatatccgcatcgttatcggtacgcttaagcactaaatcactgttaggatgattgtctagtgtcttagactgaaagagaacgccatcattagtaacgttgctaaatttcatctttagcacgatattattgctgtcactatccgcaccgttgcaaatcatccaacccttattgatggaactagagaagacactagccgcatcagttgcaggagcaggactagcgatagccttatcagaaagagatgtgaccagtgcactaacaccaatcgctgcaactagtgcataacttgccagattaactacctgcattgctttagccatttcgttattccttagataaattcaaccaactatcgacaactatataataaaggaaaagactgtcaaacgtttattttctaactttcctataacttactgaaaactaaaggaatttaatttactaaactttccatactcagagaatcagcttacttcttattgttactttataacactaatcctacgggtgttacgctggcgctacgggtagcagaccaacagaccaggacaaacggggatacaacaaccgcagggcagaccacggggaaacatagccagatagtgcggtaataatataccacttaaataattagttaactattaatagcattactcaaacatcaaagaccattcgctacgctcatgtacgctgaaaaagaaagtaataaaagaaacaattaaaagaaacataatctttccacttaattaatacatacatcattattgcactcataatcattactattgaaactatttacaatcaaactatgggggatgtgggctattgcttatgggtattattagcctattcatagtgccttaatctaatcattatacagtgct

SEQ ID NO: 4 - DNA, 170254 bp, Escherichia phage
  source 1..170254: mol_type = genomic DNA; note = HP3
aaaaaaacctttagaccctaaagaaggctatgctgttatatttgacgaacgcgagcaagaatgggtatatgttgaagaccatcgcggaaaaacagtatggacatatgataagcaaaaaattgttattgacactccaggtgctcttcaaaatgttactacagaagaacctggtgaatttgacatttggacagatgacgggtggaaggaagatgaagcatataaacgtgtagttcaacgtgataagaaaattcatgaactctataaattattcagtgttttaagttctcttattgacgcagaggttgctaatagagaagaaaaacgaaaatttaaagagctcaaaaaattctttgcccttttagaaaaacatgaacatcttggcggcgaattccctaaattccctgaccttgaaaacaaatctattatcaaagcgattataaatatctttaagtaaggaggtattatggcaacaccaaaagtgtcattttcacctagtgatattctatttgggttgctagatcgtattttcaaagataacgctactggaaaggttttaatgtcccgagtagcggtaattattcttttgttcctaatggcactaatatggtacaaaggaagtattttgctggattattatgtaagatctaagtatgatacttatactgaaataatccaaaaagaacgagctttacgttttgaatctgcggctctagaacaactgcaaatagttcatatctcatctggtgcagattttagtgctgtgtattctttcagacctaaaaacttaaattattttgtcgaccttatagcttatgaaggcaaactacctagcacaatttctgaaaagtcccttggtggattcccggtggataaaacggccgatgaatatataattcatttaagcggccgtcatttctcatctaaatcagaatttgcatttttgcctacaaaatctaagactgctgaactttcttatatgtatagttgtccatactttaatttggataacatctatgctggaactgtgacgatgtattggtataaggggagtaatatacttgaggaagatcgcttagcagctatatgcaaccaagcggtccgaatactaggaagggctaaataattagttgttagaatacatcgctaaatgacgataaatattttcaaaaccttcattgaattcactaatcagtgttttcttttcttcggcagttaaatttgtaattagttttctgaacgaattctgatttagctgccgaccatcttttttaattccaatctcattcaagaatccgatgaaacttgctcggtcttcaacaatatcttccctagagaatttaatcaaaatagaagcaatagtaataatttcgcgtacgatttcaatgtctttattcataacgttttattcattccacttagttgatatggatatagtaccattatcagtgttgattgtaaacggctttttctacgcttttaacgtaatcaatgtagtcttcctgttcatacgagtgtaaggccaagaatggaactaatagttcattatagactaaagcctcacgctcacgttcggcctctactacgttctgaagattatgactcatatcgttccttataactatcgatgtaatcctgtatgtcaaagaatgacatttcatattctaggacattaagagcccgttcttcagtatagtcagaaccaaagacgatagtaatttcaccaggcttcatatgattgaaatcgacactaaaaggaatacgagaacatacttcgtctgccatatctacgataacactacgacacacttctcggttaacctgataaagctctgcaagttcttcacatcgaataacaagttcagtggcaggattttctttgattttagtaagcatagtctttacccttatgtttttgtttgcgtttagattgaagttctgatttcttcttgtccttatggacagaagccttattgaaatcgtgttttgctacaagattgttcataatgatttataacctcatttaaacatttgtctgtgaaagaaaactttttagccacagaacattcgataatgtgctctttcaaatctttagagtcagtataacccatctcagtaataaagtggcgaattaaagctttattcttatcattaacagaattaaaataatctgctttagaatcaattattctcatcatctaatttccttaattgatattgcaacgagctaataatttcttcgttaattttaatatacatgtcacgcaagaaaggttttaacccatcacgaataattgctaacgtatcacctttacataaattaaccaaataaggatgatctaaagcatcccaaccaggctgattagcatacataccataattttcttccatcatagcattcaggcgtttgatatgattaatgtgggcttcaatagcatcaatctggagttgtttaagattcattagtaaaggtcctcagagtaaagttctttttcattaccaccacgttcaatacgtacttgtccagcgtaagttgcaataatcattgcttcttcacgtgtccaataattactatattggtcaataaacccttggtcatcatcacaaacttgttgagtaactaattgaggtttaactacatctaaaacttctgccatatctttagaataatgacgagcacctggaataataagagttcgtccatcttttaatttaaaacggttggctgcgcagacaattcgtcgttgatacttttggttttcatcccaatacagagtctgccaacagatttcaggaacttcgtctaaaacattttgttctgtatattcaccaccgtaagaagctaatttagcagccagactttccggagtctcacgcgacaaagctttatctaacagagctaaacgttctttaaaagttttcatttaaaccatcctttaatacgttgccaaatagatttttgtgattgtttatttacaccaatcgaacgaataaccggttgtgactgctgatattctttataatcttctttatagatttcgtaagctgcatcaacaaatgaactgatcgctgccatgtagtttttacgaaggccaaatggcgcgtcattattttcacgaataaccgtatattggcctgctttaatctttacaattgtccctaaataagccccgtggtaccaaatatcccatccttcctgagtaggttctgcacatttacgaagttcgttaataatattcagcttattcattatgtattcctcacagtacgttagttacaagggtaatgatttctttggacacattagggaagtcaatgtaagtatatttaccaccgatcttaatcttaacatcattttcaagagaagtaaacagctttgattcagtttctgacatgttgtatgcaaagattctaagagcgccatctcgtcgaatttcgatctgacgaatacctagaactcgtttagcgaatcgaacttctaagttactacggttttcaccaatttctttaacttcaactttatctttaatattttcaaaaacaaagtttgctaattcatgcatttcaggagtaactccacgtgcttttctggtgttacgtttctgaagaagttctggagcattttcttgggcaaagaggtctgcagctttttggataatatccattgcttcgcctgttgctacaagtccatcaccggatttttcgactaaacctttcttaatcaatacaccaatgttagagttaacaactgatgcattgtattctgcttccagagcttcacggacattggcagcagtggtgaagttgttcttaatgatataaaccattattgcagcagttttttcattcagagcgttttcagaagctttgatgatgtaagtaactttagacattttatttctccaaattagtatttgttttgataggtctataatatcatgtttgaagcaaaagtaaactttattttgggctctttttcaaaagccctggtaaaatttacaaactcatttctttaataaggccaataagttttgcctttttagaacgaagcttttctaaatgatatccgtttgaaccgcgaaccactaaagaattgatttcaacttctaagaaatttaattcttcaacaagtgctttacgaggagcattcataccaggtttaactttaccgaaacgagtagttgtgttttgggttaatttcattttagacattttatttctccaaattagtatttgttttgataggtctataatatcatgtttgaagcgcatgtaaactgttttgtgagaaaaaaatgcacaaaagggagccgaagctccctaatcatgtttgtccaaccaatacagccaaatcactagtgcagttattgcaccgagaaatcctaaggctaggcactcaaagtgcctccaagtctttagtgtactctgtcacaacatcagtagacttccaatactcattttcttctttcttagctttagcttcttctgctagtttacgtgcttcatcggaagtgatatggaagatgttaagacctaccagtttatcgacatgttctttgtacatttcgatttgtgctagctcttcagtcaaagctttacgggtcttgccttgaatcacaatttcgccactgataacttttttgatgaagtgtgccttagcaaaagcaagtttaaatgctttttcagattcaatgattttgttgtcaatacgtttctgaacgtaagtcttacggacttcaacaaaatctttgattaagtctactacattatcgtagaccgctaatttacccttttcattaatcactgtgatgttttgtgaacgacgttcgatgagactaaaatctttcatgattttttcatgacgtagctcttcgtcatctggaagcgagtactctttacggaacttcaccttaaacccaaagccgtgttcaccacaatcatcttcccatgagattagacctttgtcttccaacgggtcaagaaccttactcacatacgtttcacggtcgaatttatatgggatttcagttatctgcatttgagtacgagatgtgaacttgtacgttccgtgaatctcataacgcccatcaacttcatgcacttcaccacggaattctggaaattcaacttttggcttagtgacatttttaccttgaagagcttgtaatacggcctttttgactgatttaaaactatgaggcagaatatttgttgcgtaaccggttgcaataccagagacgccattcaaaagaacggtcggaataataggaagatagaattttggtggaacgtgttctttatcttcatgagctggagcatattcagtatctttatatacgttatagaaatttttacttacacgagcaaaaatataacgagatgctgcagctttttggactgttctagaaccaaagttgccttggccatctaacagtggatagttgttgttccatgtgttagccattaatgcacctgcatcttgtgcagaagattcaccatggtgataacctaaatctgcaacaccgcctgcaattgacgcaagtttatgaaatttttctttattaccacgagccaaatctaacgcacgatggaccacaaaacgttgaaccggcttaaatccatcaatcatgtttgggattgcacggttttcaacggtgtacatagcatatgctaaggcttcattatcaataatactttttagattacgagaattcaattgcatattttcaccatattaatgaacgaatatccattataacatctgaaatgaaaagcactacttggattagtccaaacatcacaccgtagtacagaacagtaagcaacaacaagagccctaaggctcctgctaagattttcttaatcattactcgccttttaatacgttaagaagagctaagaccgctaaggtaccttgtgatacggcctgttgaaatactgttgtttcgcctgtaactaaagtgttaactaataaaaacgaccaacacagcaatgcaataatccatgctaccattttaattacctcaaaaataaattaaaggcctaacttaataggcctgtataaattagtaactctgcagaataaatttgaaattatcggccagaagacggttcatttcagtgagtgtttgatattctgatgtatggttgcgagtgaacgctagagccaattgtcctttaccataaccagtagtcaggggtttcatgttcttggctgaaacaaagattacgtcatattcaatattattagtgcccatggtacgggcgagttgcgaacggccttgacgaatgtgagaaagaattgcatccaacccttgtttagaacgttgacgtcctacaaagaaccgtgctgctacttgtcgccaatcagatgaacctttaacaaagaagtaaaaaccttcacgagaacgaaactctttagaaacttcagaaccgtattcgccattacgaactactgcaacaacttcaccgccaactgccagaaggtctttacgagttaaatatttggacatgctaatttcctcaattgattaatgtttttgtaatccatgagagcattatactctgctctcaagagtttgtacaattttattcggctatatcagaacgttcaaaaagctcttcaacagttaaacattcagtgtcatcttcaataaagaatcgagtccaacacgttggggcgatgcagttatgagtttgtccggctatagaagctacacgaataagctgctgtccgttattcagaacaaatttttcaccaatttcaacatctttaaaaagcttagccattttgtgttcctcatgtttcagtaggactactataccataatcctactgtgttgtaaacaattaaattacattaaaatatgttaaagccaaccatgttccagtgaacgaacatgcaatgtaaaaacccgtatcacaaattgttcttagtacaataagaagtgcatttttcataagtacctcaacacaattgaaaatattatacaaatcattgggatactaagcaaccatattccgatccacattttagagctcatatctcaacttccgcgagttccatatatcctttgttgataacctctttaaggtctttagaaagaataacaccaaaatggtcgttcatatgtccgttaactaaacgagttatttcagcttcagatgacatataaggcacgtctgagtcccaatgagatagacttaaatgagtataaatcatcccttcgtcatctgcggtgttgtacattgaaacaaattcgcctgttactttatgttttgcgtagaaaaatttaaatttcatgatgttatcctcttttagataggactactatatcatagtcctacttagttgtaaacacttttatgaaattaaagatgaagataccagccgttgtagttgctcttgcggacggttttctttaggtcttcatggtctcccacgaactttatagaataagagaagacgtcaggtgaggtttctttgacatctaatataataatgcaatctgcgactcgatggttcaagaagggccctatattgattccattaccacccggataatcaccactgtatcctgtggtaaccgaaatccatttcgaatccatctgatgggtctttacttctacgcgtagaccacagtacttaggatgagctaaaacgtcccatgcatacgtgtacgggtcttctacgtcttcaatacctttattaacatatccgtctagccaatttgctactacatactcggcaaagactgcaaccttacaacgtcgaactacgtcttcttttatttgacctggatcttgtttcaacgagtaccgagcggtatcagcgatcttcaccttcatttcgctagtcaaaaactcattcgacaggataaatgtcggaagattcttcagtctcaacagccccaagttcgtctttaccatagatacctctgatgtgtagttcgccaaaataaatgcggtctccttcttcaagatattctgcatctacaggcgggatttcaataacaacttcgtcgcattctaaccagccgtagtgtgcatcaccaggatgttttaccaatttagcacaataaactgatttacacttatgatgaccacgaagattagcaattttggattctgatacgtcaaatggatgaatcataattacccctaaagaaaaaaaggggaccgaagtccccaattattattctgcaaataattcagtaacgtctgaaattacttcataacgacaagtacgcatcttagcatcaccatagtcaaccgggatggatacaacatcacgtggatgaactttaactttcacaactttatctgagcttgaaccaaagtggcgaatataagatttagcacaaacgtggagaccgcgagaacaggtttgagtatcatcgtcgttaactcgagtacgaggcattgaaacaactttacctggggagttatcaaatgtaccactatagcagtctaaatagtccttacgaactactttccacgcatagaaatacccatcttcagtgatttcaatatcgtttgcaaccaagaagtcgaataaacgttgtacagctttttcgcttgggttttctaacaggttttcaaggaatggcagatagaatttaaagtcttcacctttttccatggaatcaataatacggttaaccagtcctgaacgaatctctataccttgataaaataaactaccaccttcaatagtaacattaccatcaacaaacttagtaatagctttcttgatgttaataagttcgacagctttactaaggtttcctgcgaccagattagctttaatttcttcaaaatttgcatgacttgatggggtcgcattgtatgctacgcgtccttcaataattgaaataaatttagatgacgcgttccatacgatttcaggacgatgtccgccgataataggttcattattttcttggacctgttcttcgtcttcaaattcagctgctttctcttcagctttaaagttcttaacaatcttacgaagagtgtcagtggaaatattgaagtaatcagcaatttcccgacgggtccattggcctgatttaaccagaccgtaagcttctaactgttcttcttgagacaagcatttaatattgtacataatgtttccttatttggctgcttccacagccttcatgaatttaacgatttgagcgacttgttctttagaaagagtaccacgtcgtcccatgtagtctgacacaatatgataattggtttcgaattcaataaccattttatcatcattatcgtaagcattatctttaagcttatcgaaaattttagcacacaattctaacttcttattcaggtctgtattagtagcacctgcgaatcgattccatccccaacgattatttactgttgagagttttgcaaagtctttactgatttctttgtttttagagctaaaatacttactaaggaagttaagctcttcattacgagtaatatgattcaaataaggctgtgctctacgacttggtgatacatactcatcataatccactttatcgattagcgtaatatagtcattaattgatttttcgaacaagcattctacttcaccaagtttacgaactttcttagcaatctgtggacgaactacagtgaactctttaatacctgacaaatcagcaatacgggtcaagaaattggagtcatagttcaaccaacctttatctgcgtcaagacattcagcattagaacgattacgaactatagcataaccttggatttcatctgcttcacttgccggaataaagagatcttctgatacccaaacgtcgttttcattcttaaagaatcgatgagcacttggcgatttaggacgaggctcattagtccgtttcctgacttcaatccatggcttaacgatttgtaaaagctctgaagtcttgtacatgttaatgttgtcgccatcaaagataactttaaggcgttccagaagtttcattgcatcttcgtctgtagggtcaacgaatagtacacttttaccaaaaccgcgtggaactttaccagttaatttaacctcgtctttagacatttcaattgaattaagagctcgcattaatggaacgcgtcccttaacgtcgtcaataacgatttcaacatttttaatgttaatgccaatcaggctgttaattgaaatggtcgatgatgagctaccactttcacgaatacgacgaagacgaggggattcaacgatatcatatacgacgccaagattacaccactcaggccccattttaaaacgtttgtacaactcagaataagttagttgttctttagagtatttcagtgattcaatattagacccagccttttccatgtatttacgagcggtataaccaagagaatcaatttcacggaacacatgacgtgggtatttacaatcaatccatttcttagaatcttcagcgaacaatttagcatcaatttctgcaacgcgtttatggatatttgctaccgtacgtttatcaaatgacaatgcttcacgagacggagctacatctagttcacccatagggaatttaatataagctgtagtgcatcgtgtcatcatccatgtttgttctttaataacacttccgattggatatacaataccaccgtaaacagccatgatattaccgcgttcaccccatggagcttccttggccaaatatacatcgtcaaattcagggaagtatttgatatctttaacaccacgaacttctgcaatatcgccgagaggacgcataacataagcaatttcggatgcaaacttttcaaaatcttccgggttaaccggtacgactacttctacaccagtacggtcatcaggacccatcttatctacaaaggtcggcttaatttgtggacctgtgtcatcttggtagattacgtaaccacgaacttcaccattgtgataagatgtaaggttaaacgtatcggtatatgctagtggagctttagagccgagtccaaatccaccaatgaaatcgttactcgatgttttagttgaagcaaaatatgagttatagattcctggctcttcgtcattacctcgaatggtgaaatcgctcataccaggaccaaagtctcgaactacaaaacgtgggtctaaacgacctggagcctgaacaataaacttatcagtgcaaccattaagaatttgtccatcaatacagtttgtgattaattcacgtacacaagccaattctttgtttgtataaaggtcattagacaaaatcttataaactttgctattgccttgaatagtgaatgctgtgctcttaccaccagaaccaataatcgtttctttagccgtttcaataatcatatttttctctcatcacaagttacgtttaaaaatttctgctacttcaagaagttcttctttagtagctgtatcggtttgtattttatatcgaatttctttaaagcgttctttaaaggactctgctgattcgatatcaaaaaatctttggataagccggaattcccggagcactgctttatcaaaaagttccaagtccacgttatatgttctcataatattctcttcagtagattcctagggcactattactaaagaccatataatctatcatcttatgtgtaatagtgcctcaggctattcaggatttacgctgtgaagattttatcccacatcgcaacaactgcatctcggttatacttcttccatactgcttcagcacgtttaactcgagcttcgtatgtgtcagtgaattctaatacagcttttgtgtaaagcgcaactacttctttcttaggagtagaggaatcaatttctacacgcacagtatctgggtcatattcgaatgtcgcgtgcggataatccttaaaaactaactgaatcacagggacacctttagagatggcttcaatagaactattctctaccgtacccgtgtcaggacacgtattgataagtgctttagctgttttaagacgttccatgatttcactgtgtggagcatcaataataacaggatatttagctggtggtgcccatttactaggacagtatcctgcgccattttcgcctagtgctttaatcgcttcaagagcaacatcagtacgacgcattttagtgtcataacgttgtgcactaataatcagatcagtcgccggaagaacttcaggtttctcattcaaacaaataaccggataatcttcggcttcaaacaacggatttgctcgccaataatcataatcaattttgtcagtcagacctgaagtcatataacaatatttacgttcaaattcacggaaggctttagtaggagcatagctcttaccaccattcttatgaatttgaatagtctggtcccaaatttgaacaatgccacgagataccggttcaaatggtgttgccataaaattcttatgaactttagagagacctgcgtctttaattgcctgaacggttagtttagtcggttccatagtaacaacaaaatcgtattcatggatgccggctagttcaacaatcttacgagccatagtataactcatacctagactgaatttagtcagatgaccaacaggatgatgattaaccttccaatcaccaaatgtgtcattatcaaaaccgatataatcaatatcagcaccgatggacacaagatatttcaacacatttaaatgtactgcttcaagaccaccttgtacacgttctgggttaaatgggaccgcacgagatgggataaacataactttcataattaagccttattaaaattaaaatgaagctcctgaaggagcttaggacatctatcaattaaccaagcatccagtctttacggagttcagggtcgttacccatgagcatttcaaatagttctttccaattttcaggaagtttaactacgtcgtacacagggttttgaatcatttctttatattcatcccgctgaagtgagcccaatcccttgatgtatcgaatactatgcttaggcagcgtatctttagcttcttcatactcagctacagtataaaaccatttttgagttttgccaatttgtgcaataattacaggtgttttaacaaagcgaatacgtccttgttcaaacaattcaggccaattactaaagaaagcaagcaaagcaggataaatacttccaaggccgtcatgatcggcatcggtcataattgcaatattacgatagttcgtattctctgccttttcaccaagaataagacctgtgatagcacagatatcaaagagctctttgttcttcatcatatcagcatatgacataccccagctattcatcaccttaccacgtaatgggaatccaccgtgtagttcacggtcacgaacatcaatgagataaccaattgccgaatcaccttctgttaaaaacaatgtcgtatctgcatctttaccacattggttagctttaatatgcttatgaaccttagctttagttgcctttttagctgctttagtttctgcagccttttctgctgccaatttacgagctaatgctgcttcaacaataggcataatcaaggcttcgtttttaagaagcgcctgagcaattttcttagcatctaattggatatgattacgaatatcaccatacgttgacgttaaacgttctttagtctgagaatcaaaacgcatgttgctcatgtctctaataaacatcaacattgtgagacattctttaacacgagctttagtgacttcaatacccttatatttctttttaataccgggcaaaagatgttcgcagatatcatccattacacattcaacatgatgaccaccatttttagtatggatgttattcacataagttaaatgacggaagccatctggtgatgttgtgaatgctatagagactttatcattttcttgaatgatgttatcttcgccaaattgtttagcaaatcgtttaaaattaccatcaacctttttaccattaaatgtgaacttgatatcaggataaacgactgccaatgtttgaagccggtctaaagtaatatctaaataaatttgagataaattatgttcttcaaatgaagagaaatcaggagtgaagattactttagtgcctttacctttagatttcttagaagaccatgatttgttttccattccgtttgaacagttaacagtgatttcattttcgccatctgacgtgatgcctgtaaacaacgtagagaagatattagttaaactactcccgacgccgttcataccaccagtcttgcgttcagaatcatcgccaaagttaccaccagcctttggaatagtccaggctgctacaggcccaggaatttgttcacctgtttggtcggtaactaaaccttgaggaataccacgtccgttatcttccaccgaaacttgattatttttaatttgcacatcaattttatttgcaaacttaaatgatgtacgaatagcttcatcaaccgagttgtcaataatctcatcgattaatttaaccagaccaggaacatattcaacttgttgatatttaccaaacaaaaaacgctcatgtgcttctttagccgaagaaccaatatacataccactgcgtttcttaatatgttctacatctgacaataccttaatttcatttttaatcatgttgtctcctcgttatgaaggtattctatcatccgaaatctaaagcaaaaagggccgaagcccttatttaaatttaattttctgaagtgcatcaattgcagctaaacgcccttgttcacttttaactgtaatgaccacatcgcctgatacgatcaccgaaccatcaacaaattctatagagccttttttgaaatcaacagctgtatctggttccggaacttcttcaaagaatttaaattctgcaccataaatcagaatatcaccttgcatactaatgattgtacgtccaggtccatcggtttcggcggcaatcattgaaacaccgtaaccaatcatctcttctacaataaaatctcttgataataaaactgtatgcagagtagtgttaagacgtttaccagttgtattaagaattctcaagaaattatcttcctgacctttgataatacggtatttcttaccaacttcaaaacctttaaaacctttaaaagccgtattaaaagccataattaacccttcttaagtaagtcgtaaaaaccaccattcacatgtttaggagcagaaacccgacgagtagacagacgatgacattcagggcaaacatcgttttctcgttcagaaatccttttaattttttcatattcatgaccacaatcttcagattggcatttatagtcgtataatggcattattgttccttaaagtgagctttcaacatttgatacaaagaccatgcctggtcgttatttttgatagtaatcgtcatcgcaggaaattcagacaattcgtcaagttcgccagaatcttgctcttcagactcttgatatggatttccaacttcgtcaaagaactctgcttcattcgtggagagccagataaagttttcatcaaggatatcaccgcctgttgcgtatccaaccatgccagtagatgtcacaattttagtaggacgtccaagatggtcaacatctaatactttaaatggttccatgccaagacgtcgtgcataaatcccattatcagtgtggtctttaataaactcttcttgggcacgtttatctttaaattggtaccatgagttaacgcggaatttattagccattagtaagtttccttccaataagttgtaccattttcagtgatttcacggaagataccatagataggcatttcatcaccgagtttttcgtaaacgtaaaccacttcggtgtagcataaaaattcggtccagcttttctgtacaacaactaaatcaggattaaacagaacatcttcaaactcatcgatgtttgaatcagtagttacgtttttaatgatttgacgtttcataatattctcctcttgttttgataggtctatagtatcatagaccatagttgttgtacatcattttagcaaaataaaatcaacttgttctgccaatgaacgtctaaacattaattgacaacttccgaggatgaaatcaggtgcttcatagaccgcgatgtagtatcctttagctttcaagagttcaacatccacctggtcatcaaaccatgcataaaccgcgtcaacgctttcaaatccaaaatagaacccttgagcccaatctttgttcaattcaaatgtgtgctcaattctatggtatcttaagatattttgttcaaggagtttgtcttcatttactgtaggacgattagggacattatagttgtcgccgtgatggtagaagttacctgagattattccatgtttatcaaggaactcccatgtttcttcagagttgtcagtgccagaccaaccgtaaggtgagcgaggttctttattccaagaggtttcccaaattctgacggctttaccgtcttcgataacaattcctggtaatgattcacgttgagtacaaaaactacgttctacgcgataaactaacatattattctcctctggttgatatggttataatatcaaaaccagaggagaagtaaacaactttatgcgaaagcagctgggctatattttttaatttggaattcaggaactaccatgaactgcccggcaaaaacaatgttataaagcttgacaccatcttctacccaacggtcgctaataaatccagcgatttgcttagttttccatggcgttccatcagttgccgcagcaatagtgaattcatggtctttttcaacagaaactgatctgcatagtccccatttgaacgctttttcttctggctcaatgaactggcttttaacgtaaccaatgttgccatcagcatcacgaactttaacttcattacgaccaaaaaccggatcactcacagaaagaacttcaaccaacttcccggcaactttagagcgagaagcaacagatacatatacgtaatcacctgtagagagatttacaatattcataataattccttaagctttacgaggagacacatagcgagtgatttcagattctttaacaactcggaagtcacctaagaatacgatattgtataacttttcaccatcttcaacccattggtcactgatgaagccgcacataatatcagttttgtttggataaccatattcgtcgatgaaatcaaattctttatcagtccggaattcaacgcctttgcaaagggcccatttgaactgtacattaggttcagtagaagcaaaatgagcgctcacatgagtttccaagaatttaggacttacgtaagcgtactgagtttcagtttttccagaactaggaatgattcgaactttaacttctttaacacgtccggtaccattagtacgaagtcctaccacttcaactagacgacctgcagctttagaacgagatgcagacgatacacgcttaatttcaccaatagtaatcataatttctctctctctttgtttaaattgaattcattatactccatccatccttggatgtacaacattaattaaggatattaaccacagcactacgtggaaccacactaaaatcaccggcatgaacaacgttcagaagttcaacaccgtcttcaatccactgatcagttacccatccatttactggacctgcgaacggacgtcgaattgaaacatatttacacaacaaatcagtaggctcaataggcttaatcagagtaccgtacatacaagcgatatccatatcaatacagatatctttaacgggttctacttcttcaatcaacagttcaaagtcggtgcttggaagggcggtagtagaaattgtaccatatgaatttttaatttctaagaataaccaagggccttcaacttgtttgatgaagttaacaatagtgaaactattaccttgagtggcacctaaaatttcacaaaacttttcataagctcgcactgaagcaccataccagttgatttggttttcatctttcaggatgtaagtagccgtagtattgatattcataatgttttcctgtttggttaagatagaaagattatactccaaccatccttggttgtaaactggtttatcgctgttttacacttaacgggtcaggattctcagggacatcttcaaggccaagcgcataacgctgagcatattttaacatcaaaatatctttagcacaatcatgaatactatcatgggcaacgaatccttttagcgtacccatcggtaatggacacatacttaatcctcgtgtcaacgagtaagcttcgattgccgtacgaatatcacgttgagcccagaatttaaccggttctaatttatcagtatcaatatctggttcaagaacaccttcatcacgatagaggtcacgaatcaaatcgaccaatatcgggaagtcaaagctcataccacggcaccacatctgtgatttccattggtcaactttattagctcgacaataatctaaaaagattttaatgccttcaagcgtagtgacatcgtcttcagacggggccaagtttttacgtgcttcagccgattgttctttccaccatttcatagtggatttagcgaaaactcgcttccctttctgagaagctaaattaaatttaattcgcttacctcgttgaacaagttcttcaaatgattcaacaacttcagggtcggaattatatgcaataaccgcaaggtcaataacagccgcttttgatgtattgccgaatgtttcaaaatctataataacatcagtgctcataattttctctcaaataaaatggacgtcaaaacgaccacgagttgtgccgacatataataactgtttagctaattctgaatcggcataatggatacacggtgtataaacaaaggccgtgtcaacagacataccctgggccttatggaaggttgatactggtagtgccttcaccttagtgaacatacgtttagcatcccagaattcgctccatggagctttaccacctttattccaaaatttgtatgtttctgcggtcttagccaaaaacaaattgaatttataaagctcttcttcggaagaaataacctttatatcttcgcggatgtattcttcatcatccccatatgtttctactgtaagattccagtatcgtatcatatattcgcctgaaacaccgcgtgctttaacgaatgtagacgtttctacagcgtctcgaatacgaacgaattgcccgttattgaaaagcatttcggtcatatttttgccatctagcttatatgtcttagtaagtggctcttgtagaacaatgacttcgtctttaataaatggcttttctgtttcaagaagttttcggcgaataattgaattcaacttatctactgacttatttgtgaatgccatcattcgattttcgaaaaggtcttcaggagttttaacgacattaaaatagttcatcatatacgatttaaggtctgtatatccatgaacaccatgcccatcaactactttatcataaatccatttgccattacgaatatcagtcgcaacatcaataattggtgcattgctacgtttaacttctgtaaggttgcattgcacgaagtctttgtgagtgaagaaaggacttagatacgcagttgattcgcctgggtctaccggtcgaatctgacatcggtcaccaattccaattactgtgcaccatttagggatactagctaacattattttaaacagagaacggtcgcacattgacgcttcatcaaataacagtacacggcacaaggctaagtcgggaacctttttctgttcaaataatacgttttcttcgtatgtagttgggttgattttaagaatgctatgaatagtcgatgcttcttgacctgcaagtttgcttagaacctttttagcagcatgtgtaggggctgctaaaataatacctgattctccagaagaaataagggcttcaacgatgaatctagtaagggttgttttacctgtaccagcaggcccgttaatagttacgtgatgtttcttttctttaatagctttcataacaacgttgaaggcgtttttctggccttcggtcaaatcatcaaatgtcatcgtaaagtccctgcaattggaatactaacaatacggccagtatctagaattcgttgatacaatctttgcgtctctgcatccagtttaacgtgtttcatttcaagcttattaaaccagaacttacgcggagtttcgaccattcttagaactcccatttttaaatctgttttatactgtgttttcaaagtatcgaaaactttatctgcaatatcctttctaaaaaatactgcaggacgatgctcatcaagtggaaccgggacagtaaatccttccatatctcgataaactattgcatatacataaaccataattaacctttaataagttggaataatgatgcgctaagtggtaagccacgtttcaattttaatttaccaatgaaaccaatcttttcaaaacgtcgcagaccttggataactttatcatatgtatcgaaaagcgattcagcatcagttaatttagttttagttttccagtcagagcctttaagaagaacgttgagtttagtaagttcatggccttctgcttgatgtgagccattaatgcgtgctttcaaagcaacaattctaagtttagattcgttagataaaggttgatttttcatcatgttcgccatatgcttaacacgattttcacgttttgctcggatttttaaaatagtaccataaacctttttaatttgggcccatttcttctcgtcgagattaagtttctctactttacggacagaaggattagcgatacgtcttgcaatggcatcgcgtttcccaataagttcttctaatgttaaatcagaacgagcagtgttatattttttcttaaccgggataacattacctttaatgtagcctatatcattattaaaacgttctaaggataatttctcaccttcaacagagttattgaaagattcacctgagtaagcgcagaccttttgatcaagaatgtttttaaggtaattaaagtctaagttaaaatccttagagcgtctcttcgcagaagctctggtgtggtcaagacgacgattgattttgttaattttattatttgataacataatattttcctctgtcttacggacgttaaggtcatttagctgataggtctataatatcatgccctcaggtagtgtacactcttttttcataaaatgctttaattttttatgtgttataatggttctgagttccatccggttattccaattcagtcagtaactgacaatagacagattccagattgtataacgtccatcttgaataatagaatctacacgtagtgtagtccctatagggagcataaattcgcattcgtcagatataagtctagcattagaccgtcttgtcgcttcagggaaagctccattgaactcacaagatggcgcagccagaatcatgttaagcatatgttcacggaagttgaaagcaaatggtgcatctttgatgcagaacatattaaatgttccgtaaaaattatacgaagcaaagttacgtgctacaccgaacactggactaaagctcattactctgtcaaatttaataatactaccaatgcttttatcatcgagtgtggccatagttttcttagagattccacgatacattgtctcaggaactgaagacgtccaatttctacgaacgattgaacttaactcctgttgaatacagtctggcttgttttccatacactgccaaaggatgctttgttcattatcgttgaattgactatcaatttcgtactgcaattcatcttgatattcggggcattgagcacggcgaaccatttcctcaatttcacattcattatacggcataaacatttaggtttctcctgtggttgataaaggtatagtatcatcgtcggtagagtttgtacactaaaaattcaacatttttaaatgaatgattttgtatagtcgagataaagggtcatattctaagtcttcaatttccacaatctcaaatctagagatacctgagaccatgtactcttgttcagattcaatcatatctaggacatcaacacgcgtttcttccataacatgcttaggattctttccggcaagtacaatgttaaccatgttttggtagtaatcaaaaatgaatggagcattcctgagactaagaatagtgtacgtctgatattcccatctcccagagaattgacgagctgtaccgaaatcagttgtgaacgatgttactcgtccgggagaccaatgacatccaacagaaagaagggaaagacgttctacttcttctggagttacaccacggtagagttctactggtactgtagaagtcatatgcttacgaacaagacggtctaattcatagtggaaatccgggtcttccttagaatcggtgcaagcccagagaatgttttgttcttggcgggtgaatttgctatcaataagatttgttaggtattcgcgttcttgaagttcagattgacatgtcatgatagacctccatttaaagataagcctatcataacacgagaggagggaatgtaaactactttttaagctttcctactaaaggaccatctgggccaggttgttctaacatgaataaggacgctttaaaaagcaatgtcaaccctttcaccattcgataccatgtctcaaagtctttttccttgatttctagtaagaatttctctttcatttccaaggactccatggtggagggtcgtcataataagaggcaaggtctttcagggcttcgacaggtaaactaaagccgtgtcgttgtataatactatctagttcatcaacaagttcactacgatgcactttaggagcctcaacttcaggctcgtcaaacatactcataaggtccatattattcacctaaataaaaactaggctgctcggagaatgtttctagcgctacaccttttgtcttaaaaaatttccaaatagctcgttgcaaatggactaaatctgctaatgatgtaataaagtattttttggcaaaatacttatggtcccgcttttcaaacaggtctaaacgcttttcaggattcacataaacagcattttctgtagattcgtaccctaaatcctttatgccttcttcaagactaaacggagaatttttagaacgagtaatagctccaactcgctctacacgaattttgtaacctttaggaatctgcaatttgcagaattcttctacgatatattgcggattatttagacttttgttaatgagaatagctatttctagtggagtcttatcttctactggtatatgtttaaacgacttggcttcaagcaaatacattttaaataacatagcatccattataatttcctcgatggttcacccatataaagttttacaatacgttcgccttcatcttcgacgagcttttcttcatgtttctggaattctttagccatattctcttcaagaacatccagccaatcttctggaccgacaccatcgtcccagcttttaaaccatttaactatcttgttcattcgcagctccctgagcttgaaccacaatcagaataacttgacccagaatcacctgacccagaatcaccaggccaagacgatacgtatgaatgattataacttgaagagtttgaagcagacttaggacgaataacttcttccatcatgccgtcgccaatgtattcccaacttttttcgtgtgtatcaggaataggcatcataccttcgcctggtttaacagcaaataacttcttcagtatcgtaagcattaattgttcctcgaacaaaacgaacaccaccatcatcccaacggatttcggcattaaatttgacgtcttcaccatccatcatgaatgagtgtacgactacatcatcgtaatatccaagaccgtatttcaacgaaacttcttgagcaatcaaagcacctaatgtgttattaggtttaatccaacgatttaacatattgttctcctcttgagtaagtaagaatatcttaacacagtttttagtggatgtaaactctagaaacgaaaaaaggaatcccgaaggattccttaaattatttaaccacttactggtgtaggggtaaacattgcagcgttcttagttttccaagttgctgcatcagaaacgacatcagaataagctgccttttctgatggaaagatttggtaatgagaatctgcaatccgatgttcgtttgaataaatctcaaacggaacagaaacttccatacctttaacttctttgccttcaccagcaggatgcgtaaaggttttgatgtttacataaccacccataattaactcctttgttgtttaattacaggtttatttataatgaattcctgtggaacagtaaaatatccgaatttagctaatacaacaacatcattaatgattactggagaataatcatctgagttattaaatttccaatgaagcctgtcatcatatccatcagaaccaaatgctcgagtagccggtctcccggctttttgccatgcgtagaaatcaaatttcactttgaatgctctataattaattttaaagcttcttcactgacaaaatttcgtcaggaccttctataacttcaaccatacgaagttgattagttaagagctcacacacgagctctttgttataatctttaaatagctggtcaatacgtttcttatgggctttcttgagctggcgtttatttaaacgagccattaataacctcggtcttgacgtgcgaaattttcagcatttttcaagtagtaaagtttaaagatttcttctgctgtaagaccaagaccttggaacatgttcagaacgaaatggagaatatcaatcatctcaaatttaatttcaagctggtcttcaggagacagttcatcgatacgacgatttcgatattcaacatgttgtgctttccatggcttccatacagagctagcggctttttcaccattgctcataccaccaagtgaagtcagcagttcacggaattcatcatcaatataatctttctgattacgcagccaatcaacaacatcaccagcagtagccaattcatcaggatgtttgttatgttcaggcttgtcatttgccagacgaacctgtaaagatttctgcatatcaagcattacctgcagtgggtctttatcttcgtgaatcagagcattaaaataagcttcttctgctttatcaacaccagaaataagttgtgaacattcgttaaagtgtgccattatttttcctttcaattcagtataagaaagttaattctaccattaattttataaagcgtaataaataataggtaactaaggagatattatgtttaaacttccatcgttaatcaacgctattaaaggcaataaaaagaaaactgctatcgctgcaatagttgtaggtggcattatttcatggaacttcgggattgcaccattgttagttgcccatggtgttatggttccttctgttccattggatactgtagttgatttggcctttgctattatagggcttgtttaaatcttcgaataacgagataatctcattttagcatgcaacccacttgaaatattctgtttcatatattctaaaatttcttgtggtgttgcattttctttcattacaatatcattcacatcctttgatctccatggagctcggtcccagaacatgacacgttcgcctgcatcaactaatcgcttcatgcgagctatagtatccggatgcctaggttcattatccattacccatacccgacgttctttaaatggtaccacatctaaatctatcgagccgcctgtaatagcgattgcattgggtatgaataaactatcaatagggccttccattacccagacgtctccttccttaacacgttcaacaccataaatttttgttgcagactcaaacgctttaatagtgatatatttctgaggagcatctttacgaagtgcacgtccttggaatgactcggccttcccatctttattaaaaataggaatcactaaacgcggttcaggaatctctttcttatacgtaccaggttgaatcttgttgaccaatttgggccattctaatgtgaaccataatctgttccacgattctttaggaatacaccgagacttaacatatttcacaataggatgctcttcaggcagcttgtccagacgagaacaagacggcaaagaatttatagtctttttctccggttctggtttatgttcaggaaccttttcaatctttggttccattctagctttttctttacgaacttccattagatattcacggtaaagctcttcgtcatactcttttaagtatccagaaattgtattatgatattgacagttatagcaatgcacattacctggagtaccgccataataccatccgcgagctttcattgcatccgtctgagagtcgccacaaactgggcatcgaaatgttaatttaaatgtgcttgaattattgatttgtctaaaacgaggtaggtgagaaaacgcacgataagcaaattcattatctatccattcagccatagtattctccagaggccttaaattaataaggccatcatatcacaacttattaatatttactttaattcgctttcttttcttggaaggaatttgttctggacctttatttacgactgcacctgtagttgttcctgatgcaatagcttgagggctgccacctgaatcaccagcaaccatatcctcaaataaagggagttctttaaatatttctttctgttgttcttcagtaatgttatagcgtgaagctacagcactccaagcagacatcattgaggccattccattaagacccggaacagtgctcatcattcgcttcattgaacgaactgaagcatgaaaaggtgtataagccgctttctcttcgggagtagaaggacgtttaagaacacttccacgttcgtcgatgattttggcttcgtatgctttccattctgtaaaaggtttttgcattagtcgaataaacttatatgcataaactgaatctattgcagtgttaataatacccataggtacctcctgagtatatttaatcaatcacaaagatcgctttatcaccgttcgcatctgtgacttcatatgtagtgtcttcatagtgtggaatattccaaattacgccatcattagcttttacgctaatatggcattggtgttttgaaacaacttcataatcttcaaaacttgtaaaaacactaattttagaaccagtgcaaattgcagtagtcattttaacctcgattcataaatgcattaaatatttggtcatcaacagaaatttctaattcgacttcaattgcttcaaccttttcttcaggtggtaattcgtatccacacactacaattttttcatcgatatcaaaatatacagaagcaatacgattaatgttactttcagttaagtctaaatcaacatcaacatctttttgacctacacttaaaggataactaatacgggttattttattatctttaacaaagagtccaccaacatactctgtactacgtttaaagtttacacgtttccgaattgaaagatatgatacatctttaccgtgagctcggctcataggacataatgaatagctagaataagagatgtcaaatcctacaccttcaatatgagccagagtatcatgagtaaaccaattatagtcgtatgccaaatccattaaattataatatgtgaacggaacaggattaacatcatatgttgtacctttaaaatctgcccaggcaacgatttcgttatctttaacaattacaaaaattacaccaatatggtatccgttattattttcattcggcgttatattataacattgtgcattaggaaatttaccatatttaaatggcgcgtttttgtgcatataataaatcatattattcacctgtgatttcggttacgatatctttgttatcgaaattagggtcacaatacaaaacatagttgtactgcatgataccaccagacttaagttgttcaacaactttattaaccatattaggacggtctcgtttagtaatgttcatgatatcagcgaagatttgatgttcaacatcttcttgatttgcagtcattgaccactcacagaggtctttatcataacctgccgtaactggagccggtgcacatgatactgcaagtaagattgctgccaatgataactttttcattttaactccttagttgatttgataggactactatactatagtccatctataatgtaaacaagtttattctttttcgcgaataataattacttgttgaggctgctgagcagatttcttttcggcaacgatagaccaaattaaagttccaatccaaccaaccatcgtccagttaaagagtaaagatacaaagaagattgctgttgggctttttgtgccacgaataagtgcgattacccaaggcaacatgtaaatgatgattgaaccaatacctgcgattaaaactgctaccgaactagctacgaataattccatgttaatttcctcttgatttgttatgtttatagtatcttgttttaactttgacgtaaaccaattaattaaatttgtttaaacgttcaacacactggacgtagttattcgcgatttgtttctgggtaggctctttaccagttgtttcaacatagcgaatgaatgcgatttcagtagcctgtaagcaatgttctttaacgcgttgttcttttgacaatgctacagtatcagagtcacgataacgttgagcatgggcatcagcttgaatcattcgattacctacagtaaccgggtcttctacttcaactttaggttgttcatattgtttaacattaggattgtaaatcaattggccgacattattagggataaagccgtgagcaccacatccggttaatccaaataccattgctaaagcgattaattttttcatttcaatttcctctgtagttgatagaaagatagtaacacagtatgtggtgcttgtaaacagttattttaaaattatcgaaaatcagcttcaaaaactttctcgtcattaataaatgctttaactaatgcattgttcacttcagcaagttgtactgcaacccactcgatttcttcacgatcacctgataacatgatatctttagtgaacatctcaccgcttttaaaccagccaataaaagtaactttagttaatttgctcatatttcctcgcaaaatgcccattcagcgtgataaactgtagcacctttagtatcattcatttgaactacgtctaccggagaaattactcgatagagacgtggttcacctccataagagcgtgctgctcgtcctgcataaatctttgctaaaccgatatcttcagtaaagaatacacgattcaagtttttcttacgtccagtttcagacagaactcctgtttcctcaggaggacaaagcatgttttcgatgttagctgaactacttgaaccgtgataaaaaatcttaaattcttctttacaatcgatggttttcattttgttctccagtagttgataggtctataataacacaactactggagaagtaaacttaaaaacgtaatttagatatatctgcgttgatttcgttttggtttgcgtcgtatgcaattaaacgaaccgctttagatgggtcattcaatgcatagaaatgatggaacattgctcgaacgatatcgccatttacgagttctacctggataggagaacctttttcgagttggaaatgttcataagctttgatggttcgcagataatcaagtttttgatttccggctccaacgatttgtacgatacgtttgcccatgttttccatacgagatacaatagatttaggagcaagaataacgtaggttgccagcggagaaactacttcaacagttgtgttttcggtgattgcagtaaaaattgcttgagacatattcataatgttttcctcttggttggtgtaagtacatcatatcatgcctagaggaagatgtaaaccccgaaaggagaccgaagtctcctttttattaaaattttaactcattggctaagctatctaggtcagcacgtgttgctttggctttacctacgcgttccgtacgattcacctctgcctgacgcatctgagcacctgcgttttcatttaccgtgttaggtgtgttcatgccttcttgctcaatctcaacccatttctgattgcctttacgtacacccatcaagaacttgttccacttattcttatcgccatatcgtgatttgatttgtttgataagttgttgttcagcttgtgcaagttcttcggtttcaattacagccaacatgaaatctgccgttgctggtaaacctgctgattctgcaatatcgctcatgttcatgtctgaagcatcccatgctgcacgtcctacttgagctgcagtccatagaactgtttcagattctactgctaatgcacgaagttcttctgcgatagctttaactaatgtgtaactattttcagtgtaaactctgatacgacaagacccacaaatacctaagtaatcgactataattacagacggcacaaagttcttcttgagtttcaattcattaagcaatgcacggaatgtattagcattagctccgccagtaggatactgtttgactactaaacgtcctaatgtggattttgaacgccatttttccatcttggctttatattcagcataagatacgttaccatcatcgatatcatcaagtgatacgtcaagcatgtttgcatctatacgcttagcacaaacttcttcagccatttccatggaaatataaagaacattatgtcctgtttgaagataatctgcagcaagtgaacaaaggcctaaagatttaccaacgttaacaccggccattaaaacattcagtgtaccggtttcagcaccacctttagtgattttattcagaatgtttaatttgaacgggaccttacgtgctttatttagataagaaagccagcgtgcttcatagtcttccatccagtcatgaccaacataactatcaaacgaaattgaaagtgcttgacgcataatatcaggaatagctcctacgtcaggcattttcttgttacgttgttctggaggtagttcagcattagactgaatctcaatgattttggatgtagcattatacatcgctttttgctggacatatttctcagtttctttaaccaaccattcatggtcttcaggagtatcagccaatttttcaattaggtctgaagttcctttatattcggcttcagttaaagaactgttatctaaagccacctttaatgcattaatggatggcattgcgttatattcgttaacgtggttctttataattttaaagacattttttgccggtccacgctcaaagtaatcagaatccatataaggccagaccttagaaaaataagcctggtcatatacgagatgagacaaaataatttctaccacgataactccttaaaagaatttaaattttttcttggttcgttcattaaaagcttgttgtacctgcattgtaacacatttttcaacatgtggtgcaagttctgcttttctgtcctggtcaagaactgcaaagtccattacgattttaccatcaacccagtctagttttgtaatatagactatatgatgagaaccatcttcaagtgtaatcagaatctcttgaatgacattttccattgctgaacggataattttaagagattcattaaacactcgttctttgcgaatgtcttccccttccgaagaaggggattcatcaacgatttctagatttaaatcatcgagattattcatcgaaatcttccatttcgtcaaggtcgttttcaatatctgctgcagacggagcatcagaagctttaaccggaactttagttgttgctttgcaattaataaggtcgttaacagcgtcatcaacttctttaatagaagagatagcacctagtttatatttagtttcaattgcatctcggaaaggtttgtgtttaaacaaaggtccccagaattctacgcaatcagtagctttagcacgccatgatttctcttcacgaatcatttcgcctgtttcttcgtcaaggaattcgcgagcataccacccggctttaggcttaactacaaaaccaatttcagttgccatttctagcaagccactgaatgggtcgataccgccatcaaaattaactgtgatcgggaaagtagatttctctttaactgtacgagatttttctgctttcaacgtgaagtcataaccggtcaattctgtaccttctttaacctgacgtttagagataaagaatacagtgttagcagagtaaagaatacctgtaccaccgcccataatctctttaggatatagtccgccgatttccattgctgtatggttgattgcaacacatggaatatctttaatagtcagatacggggttacaatacggaaaagagatttaagtgccttagcacgagacatatcacctacgactttctcgttcaatgcatcttcggtttctttcttagatgcagtattaccgattgaatcgataaagataataactttatcaccgcgttcaattgcatcaagctgattagtcatatcaactttaagttgttcgacggactgaattggtgtatgaactacacggtctaaatcaacacccattgaacggaagtaagattctgaagcaccgaattctgagtcatagaacaaacagattgcatctttatatttcttcatatacgctgcaaccatagttagtccaaacaatgttttaaaatgtttagaaggtgcagcaaaaatagtcaagcctgattgcaatcctgcattcagagcaccacctagtgcaatattcaacatcggaatacgagtagggacttcatcacgattattaaacagcttagacttagtcaagtctgcagtcattttagaagtagaagctttaatcagacgagattttaaatcagacattgtatttttccataggcatcattatattttactcatgtttaaaagataagatgattatatactaagagttatacagcatttaaaactttaaacaggctcttaacgagcccatttgataatttctgtaatcaaattattacgttcgcttgcattaaatcctataactttgttagcaccatcatgattaagtaattgatacgtttggattttgttatgaattgcaaactcttcaaaatgtgaaatgactgtattaaaaccgaatgaagacaaagtaataaggtcgtcttcaaaactttcagtcatttcattacgtgttaaaataattgtgaacacatcatggttttggcaaagacgaacataatcctgttcataaacatcaagaaccgagtccgcatcttgtcgaatacgtccataaacccagttactaatatatccacggtctaacagataaatcttagtagggtctaaataattcaacatcgtttcgaaacagccaacttcatttcgagacttaacatcgaaacgtccatcaactgttcgtttagggaaatcaatctttacatatctttcactaatttccattatgtcattaatgaaagttgttttaccggcattatccgggccgtctactaaaataattttagccattttattcctcgattacgacatcttcgtatttaggtatattatacggcgaagaaattaaagcattaaagtagatgaactcaccaagacctggatggaatacttcttcaggattttcgaaatattgaatcttcggacgtcctttaagaatttgatagtactcagttttagttggattaaaaattcgaatcagcgcttcttcaggatacttatttctgtcgaagctattatttggatcggttatataaagcggttgacctaattgaattgcgcattcaaccacttgttcaaaacgataacacgggtcactaattcgaaatggatgaaaaataccatctagatgaataggagccaaatcacctacaagacgctgcatgacggaaggacgtataactttctgcgttacgataatcttattaccatcggcacctgcgttaaccagcacttccttttgacgttcattcaacacagtagtttgaagtgaacgattaacagacaacatgtcggtttttaagaattcatcaatataaaaacgtggtttattagggtctgcagtgatattgaaattgaattctacgtcaaaagcgccatcatatccagtgatatctgtgattagaaaatcacaatcataataagcaattaatgaatcaaccacaaattcattttcagaccaaaaatatttacgagtgttatatgcgttatctttataccataatggaacaaacttaaattccgggaaaagacgttcacattctttaatatcagatgcattacgtggatatgtaatcacatcacctggattagcacggtgcaaatgaagttggaagttgccatccttaaggatagcatactgtccagtttcataagaccgcatactcaagataggtacgcggaaaatagccattagtcaaggaatcctttaacataatcaaaatcacgttcaaacacatgggcacttaccatggtatgagtataatcaccaacttctacaccgcattcgttagcgatataatgaagtaattttccttggagataaaaatccaactgcataacaacagcacagttctgagaacgcatatggcagtgggtataaagcttaccatcacgaatataataagtcactgagtcagtacatggatattcaagtgtttcgtccgaatcaagcaaagcctgatcagaactttctagaatttggaacacaactcttcgagagttaggtttctctttaagttcttttagaagagctggtaattgggccacaatgcgaggaccatagaaagtgttgaagttcgcaggcaaagcatctgattttggtttagaaatgaatttagcgacattaggatatgccttaaacgcttcttctgcatcagtaccaccagaaatcataaacttccagaagtcttcggcatattcataagagatgcggttaatacgtgggtcggtcattttgaacgatgatggattgtcaacaactactgtcatggacccgatttcattacaacgtccaatacgagaatcagttacgaattccgggttttctaaaatttcacgattgactgctttaaatgcggtttgaaaatctgcggctttgatatatttcattgtgttatgttttcccatgtttacctcaatacaatttattatatactcaattcataaagcttatttgaatttcttggcaatgttgatataacgtaaagcttcagaatctatacttccaagaacactatgaagaaatgcatcagcgtagtattccaattgaacaggttctttaatcactttagccgctttggtttcaaacaggcccatcagggcctttttaagaatttgttcattagtgttcagttttatagtcaaaatctcttcattaagttggtggttaaaagtttttctagaaatcattccgggtacctcaaagcgtcatcagagttagttatatcaataatagatatagagttttctgataacccatttttagataactgacgtttataatatctttcacaatatgtacacgtcgtcccgcagatttcattagcacaatcgaaatctggatgtctgaaccaccttttttctaaaaagccatctaacaaagaggtttcaatatttactgtatgtgaaaactcagtttcgttttcaagagtgaaaatagtctctaaaggcttccacagttctaacaaattaccttcaaacttttcagaagcgtatgcttcaagaactttcaaaatgtagtctgtgctacctgtacgtcctgaaactttgaattgagtgataccaatatcattataaagtttcaaatcttgaggacgaacaaaacgagttctcaaccagttaaatgggtctgtatcacgagctttaatacagtgctgcataggatatccgtttaaggatttagcatcatcagctgtaacatcagtactatggaaaatatagcaagagtcacgatagctacaatgtgttgtataccctttaccagcattagaacagaactcatttacaagaacttcaaatattatattgttcttattgcaaaactctgctgcacgcttcaggaaagaaactgaacggttcttatgaattccgcaacagacttttttgatgttatattggtcgtgcaagtatttgatttgagttacggcatcaacatgtagaattgttgaaacttcaatctcaatatctttattgacttcacgaacaatttccataacaacagggttagcgatagtaatacgccatacgcctattgaccaaagatactgaacataatcctgaatagctttcttcttccactcaactagttctctttttgaaccaggatttatcgtgttgagtgtatagttaaagcaaatacctaattcgttacaacgtttaacgtagtcttctaacatctttttgtcaacgtcaggaagcctaaaatcaggtctggctgctacaaaagccatttctcttgtagagccatatacttcgtttatcaagctattaggataggttttattgagctctacgattttatcaagaagagctaaatcaaaattcgttccgattttaaaagtattcattttttgcatctcgcgttaattgatgcgatggttttttgcaggtcttacttaaattattatagattcggtttatatgatttaaatgtttcgaattcgcctttattcataagagctttgaattcgtcaggacgcatagctttgtcgtcgataatccaatcatatactggtttatgtgttagcaaattatgatacttcaaaccaatgttttccaagttctgaatcagacttgggagaatgtcaattgctatacgtccaggacctactgacttcataccgcgtgcagtataaagcgttatagtatgccctgcatcatacagggcattaatggcggtcaccatttcgacgtctggtttgaagttcacataatcacgattgttattccactctgttatacaatcatcgacatcaaaacaaagattaagcatgttttctacacggtgcattagattcgttcccattgatgagtgatatcgccaccgattggacgataggaaacaccagtttctttatcagttagtacccatttaccaggattttttgtaatcagagtagccgttacaggttctgctacgtcataactaatagagccgtcttgaagtacacggcccatgttacgtaattgcttagtcagaagttccatacctttataatatgcggcaaccgctttaagtggattattcttgaaataaccacctaatgcaatccaaataattgctacagccaaatgatgatactcgttaaacgaactcatctttccatatttgtaaactaatggattgatgttaatagtcacattacaagttgtttcatcaatagtaaactgtccccaggtcggattagcattgaattcatcataacctgaaacagcataaagcactttagcttcatcatacaattttggcccgtaaatcttggtttcaccaaaatatccacgagggtcgataaacttgacttcgccgttatcagtaatcatagtattactgaagtttgggtcaccgtgaataacagagtactgtccctgagaacggttatgataacgaataagatgttctaaagcttgtttcaacattggcttcagacgtccaatcttagtgtagttcacgtgtgtgattttaccaaatgaatcaatcaatggctgaatgctttcacaacgatcaataactttcgtatagaactctttagtgaaatcacggcgaacagtttcaggacttacaaaataagtgtctgtgctgaatttcagtgcatctaaaattgcatcaacaatttgtggacgagcaagacttgatttggatttaatatattcaaatgccggcttacctttaatacgttccatttcaaaattattttcatttaccgaaactaactgaggaactgaatctgatttcactttcaaataccatgaaatctcatctttttgaagagctcgaccttgttcggttaacgcgaatttagttacagtttcttcgccaatttcaactgcattaaaactacgattaagttcacgaacttcatgagctttttcaagtttaggcatatcacctaaatcaattagattcataagctctgatttattgaatgcactgccgtaaaggaattctacgaaatcacgtcctttgcagtattcgtgaatttcctcgtcagtagaacccatgtagaattcccagtctttgaactgataaattcctacaacattaccgcctgttgaacctacgttagtgatattttcaccatcgaaattatatcgacattcatcacccttaacatagattgcgttaacattccaagaccatgaaccaaaatcaggaataatatcacaccagttaacaattacattatggccatctaaatctttgtataatttagcaagagcataagcagaaccatacgcttcatcaactgtacgaatagtcacattgaacccttcttgctcacaataagctcgaacagtttcagcaaattttgaatgaactactacaataatttcatctgcgccaaggtcagaataaattgtatacaaattgctcagaatagtgtcttgcttatagttcacaagaacttttggaatatggtgagtaattggatataaacgagttgccaatccagcaccaagaataacagcttttttcatgttgaagtcctcattggtaagtaggtgtattgtacactattctagttaaagcattcatactttgcttgtagtccaatcataatccatccaattacaagtgttggaatcattactggagccgttaagctccagtagatagtcatgacaagcatcaatagtaaaagtcctattgttattgctttcattgttcgcctcgtaacatggcacctagtgcaccgcctggatggaacttaaggaagtcattagaggtaaatccacgttcagacgaaaggttgatagcaaacgtatcgataagcgctaacaacaatgtagtggacatggtcggagccagagaattctcgtcaacctctaccgcgataccggtacagaacgtataatcaaaaagagcttcgtattcttgcggaatgtcagggttacaatgtaacagaatctgtttaacctgaggacgaatcatacgaagatgtttagcaacacctatcatttcttcagtcttaccagaacgactgatgtgaactaatacatcattgggtgcaataaatcctgcatccccatgagaataatgcccagtgttcaagtacatactcgggataccgagtgaagcaaaagtctctgaagctttagttgcgatattagcgttcttaccaacacctgtaataattacacgactttcataattactcagtccagggcgacgaagagtttcaagaataacattatatcgggcagagttttgactaattactttagccatagtggcaagagatgaagcttgttttacgattgcgtcaatagcgatagtgattggtgtagttttcatatttctctcatttaattagttggccgtccttggcattatatcaaaaatcgaacatatcgaacagagatgctttcttctcgtaatcgagtttcgctgctgatgtgaatccttcaagtggtttaataaatgtcttctcaaggagaacagtgtagtccatccaatgaagtacgtcgtctttaattaaatctgtgatttcagtaccagaaggccatgcgatacatttatcaccgaacgggtttccatcacgtaaaggcagaacgtataccttttcgccttctacaacttgtggagcatcaatattacctttgatagcccggttatatgtcagaattccacgaatatggaacggacatttaggaccagggaatccaccaacgtcatatttagcaatgttattcgcagaagataccgacgcgatgctaatataattcaattgacggaattctttttcaaactctttaaaatattcttgtaatgattcttcaccttcttgaagcatacgacgaatacattctttaagagctttctgtactgctttaggggtcgaagatttctgagtctctagacccatgattttgagtttaggctcagcgtaacgagtaccttccatatcccacacgtttaatgcgtaacgtttcttaccagtccagaatccaccaatacctttagaaccgagcggaggaccagcgatagcttctcggtccatgaacattaagtgttgtttattgttcatgtattcacacatttcacggaaacctctatcaatagctggttccatacgttcacgtgcaaacttatctaagaagtctacccaatggttggtatcacggaatttagattcaccaaccttatcaataattttatctgcagatacataaatggagtctgtatcaccatatagaacgaaagcttcaccttctgtaccacaaacttcattcagatattcattaactttacgttcaatccactgtaaagccatttgtccaaatgttgtgattgcagtagcattacgcaaatcataataacggaaccaaacgttgccaagtgcaccataaagtgagttgataagcaatttacggttaatttgtgcagtcatacctgcaacttcagtacgttgagctctaaacaacatttcattaagagatttagcagacaactttttaatcttttctttaatctcgtcagtgaagtcgaaacgataatcaacatctaatggttcgtcaacagaaagattaggattatgcaatgcctctttaattatttcaccattacgttgagccgcaagcatgtaacctttatgttctttacgttgattaaagaccttagtgatttcagttggaactacaccgtcacggtctttataatacatcatgccgttaggagagcaactgtacacatctgaaggacgttcagcgattgcgttaatataatcatgcagtggagctactttaaacgttcctgctattgtttctgggctaatattcacttggcgaataatacttggatacagagatgtaaggtcgaaactcattacatatttgtatcgatttggaataggttccttaacaaaagcgccaggataaggttgaaccgggtgagaacgaccttgtggaatcaccttgttttgttctttaaggctattaaaaataatagcatcccatgttttaattgggctaaacacagattgaatctgtatcttagcataataacccatgtccaaactcaagttgatgaactgacgcttagcatcaatttgcaatacacgatacacgtcgataatgttataagaaatatatcgttggtgattgctttcacgaagcttagaaataggaccgtcatatttcagtttaccgacattcaattcaaattctgaaatgtaatccagagaatacgacggttgattggtaaaagagaattttttgtaaaggtcaatgtaatcaagaacagagataccgaacaatgtaatgatttcacgagaaccatacatgttttcgataactttaacacgagttttacgatgtggtgataaacgtttcgcagtagattcgccaaaaatattcttgattcggttatacacatatggaatatcaaatgactcaacgttccatccagtcaaaatgacaggagttttctgttgccagaagttgagatattccatcaacaattctttttcgttatcgaacggcatataaatgattttatcaataatttcggatggaacttcatcaccaccttgttcttgaagcttagctgcaatttcgatagaccattcttctacattaccatatggagaattcaatagatcaaatacgtagaacctgtcgtcaattgagtcataatgggtgatagcatcaatcggatgttttgcttgtgacggctcaggaaacccatccggagatgttacttcgatgtcgaagttagccacacgaatttttgtatggtcgtatttgatttcatagttataagtgtcagacaaatacgctaatttgaaatcgtccatgccaagtgcttcaagaccgatatcttccatgcgtttaatccattgagacgcatcacgcatattagcgaacaacttacgagtacacggcttaccgtagatatcgaaatatttcgtagcttgactttccggacaatgagcaaacagtgatggtttatattctacttcacgagtacgttcacggccattagaatcgatgtaacgttcaaaaattgaatcaccaatctgttcaaccgttaagtaaaattctttcatttaatttcctttagacgagttattgtcttttgtttgttgatgaacttattatactccaaatgggaccgaagtcccattgctttaattaccaattgtatattttgctttcaaagtccagtcatctttctgtttaaaagagataacacggaagttattagtcaggctaaatagatcttcacgagcagagtcttcaataacaatcaatccccagtcttcaagcaactgagcaatcgaatcacgtcgctgatagtcttcaccatcgatatcaacttgacgtccgtccatacgcagcatttctttaaagtggacgatgtagtatttaccttgcttttggaggatatgacaggactgataaaggattttatccttgttattagcgatgcccatacgggtcaaagtctctttgactttcagaaaatcttcagggttcttcaatttaatttcaatcatttttaccattccaatgctaattttttaaattgtttttgttcttttacgtttttagtaacttctttgagaaattcatcagtgaccatggccttcagttctttaaggactattggcagcttgttatttttttcaaggagccgcttatactcggtagcatcattcatgttgattgtgtaatgtttcatcaacagtttgataactagtaactctgaagtgtcttcgactagtttagcccatttagagaatcgacgaccacgcggaattgccgccatcatatagttgaagtgtgcttcatcgcttaattcagaaccgactaagttcatcatgtaaacggctggcatacattctggaaactgggataatgagttctcaaccataaattttgagtagtcgacctgagcaattgacatagatttcttttcattaatagcattaatgattttaaagaattcattctcaggtttttctttaaacatatcagcacatttttgaatcgcatcagcgtcattagacttccatgcaatttggtgctcgttaagctggacgtcatcatcgaataagttcatattatttccaagtcagttcacaggtcagttgaagaagcatatacataacatgtaattcaatattacttgctaatccgtgaaacttattattttcgcctgcaatttcataaagcgaaataatacttttaccaggtgcaacttggtcataacattctgaaactaatttatcgatgaaccatgaataatctgcggcatattttggagctaatgcacgaagctgttttatatctttgttcttcattgcttcgataacgtcagagactgtgccacggtcattagttacgatagacaaaataccagcatcaagaacacctttagacgagtactggtctaattgaccaattgtacgacgaaagtccgggaagttctttttaaccagagctgcaacaactttcatatcagcgatttcgatattttcgttcttacagatttcaaccatacgatgaatcattttcttcatcatcgagattttatcttcttcggttggacgtccgaattcgataactcgacaacgactacgtaatggttcaataattccatcgatgttgttagcagtaataacaatagagcagttactagagaattcttccataaacgtacgaaggtgacgttgtgattcggcgaggccactacggtcaaattcatcaataacaataactttcggcttgccttccattgagactgaacgagcgaatgcagttaacggaccacgcacaaaatcaatcttacaatcagaaccattgacaaacatcatttcggcattgatatcattacataatgcttttgctacggttgttttacctgtaccaggagaaggagagtgcaaaataatatgaggaagttttcctttagatactaaagacttgaatgtttcatggtcatacgcaggcagaatacattcgtcaatggaagaaggacgatatttctgttctagaatgtgttctttggaattgatagtaatcatgtaattttcctcattatcattaaactggaggatttctcctccataatcgtactacattaaacgtaaagctttgacttagaagtcgtgagtagaatcggcttccattgcaataacataacttacttgagagctttcaaacttggctgcaactttatcaccagctccccacaacattactttatagttacctggctggattttcatattagccatattgattacaaagttaaagttattagaaccatcataatcggtaagagtcaaagaatacttaggacgagttagtccagaatcttcaactttattataaccattgataacaattttaccatctttatttgtaatagcaattgtatcaatctggagaccacgtgaaactcgaagcaattgttgaaggtcttcagctttaatttcagtaatcacagaagccactgggaattgaattggcttattaggaaaaacaatggtgctcttgtcggcagcaggccaataaactgtggaacgtgtatctgcaattttaatattgccatcagtgtgcattgaaatttcagcatcatcagacactagactcaaaatgcttaagaagctattcaaatcataaagtgctacgtcaaaatcaatttcatcagagatatttgcttccgcataagtggtgccattaactgcacgggtcataataaatttaccttgactcagcagaataccggagttaatagaggcaaagtttttcagaatagcgatagtatctttagacagtttcattttatttcctttcaagacaattcaaagtttaacaaatttattatgcagcaaccatctgctttttaatagcttcaggcagtgattcaatatattctggaattttagaagcaacaatttcgccagctgcaattaattgttcgtcggcatcaacacagtagaaatcttccagacgctcagaaccatctttatcaagaacgatttttccaccagcttcaatagaatctttatagtgcttacgcatcagatgaatccacatatcagatacatcattatcaataaaaccataaatcataaaacgagtttcttgtggcaaagattgaagctttttagcacttgcgtcatcacaatgcaggacccatgctttacgaacacgattatggttatgtgggttagcgtcagtacggatagaagtaactttcagatcagcagcagtgaaacctttagcagtagtaaacatattatttctctcttattcgtagaagtcagtaactgtccatgcggaattgcgattagacattattttattatactcatctttaaaagcagatttgagcatttgttcagtaacaatatgttcttcacctgaaaacgtattggtcaaaacatattttttaatttcagggacaacaagaagatgttgtccggttgaatactccatgttgttctccatttaatttgatgtggtcattataaccacatcgtgttaaagcgtttatgaaacagtcatcacagtaaatcgtccaactttgctcatttgaagatgttgtccataagcttgtgggtcatggtctctgtgactaattataaacacgtttgcatcggttagagagttaagaattgttgaaatagctttaataccttcagaatcagtcgcggaatccatgacttcgtccataattaatgtattgattctaacaccagagatcttttcagcaatatctcgccatgtaaacaacaatgcgatatcgatacgtgccttttcaccttgactaaatgaagcataactaaaatcttcacgaccacgtgattttatagattcattgaattcttcgtcaatagaaaacacataatcagcttccatgattttaaggtaatggttaatctgcttgttgaacagaggcacatattttttaatgatagcacctttaataccagaatcttttaacatatctgttataataccacgatggtatttttcaagaacgatatctgattttgttttaatgattttatcaagttctttttgaagcaaagctatctcatcggcatggtcgataaattccgccgaggcttgttctattgcagctttaactttcttagctttatcaatagtggcaatcattgcttgtttcttagtacgaatatcagatgcaaggtcctgcttagtcttaacattagctctatattcgtccactaggacactcagattatctctgtggcaggtaagttgctcgaatgagtgattacattcatgaagcttatcggtaatcttagagacaataggatcaccctggtgcaactgtgatgcacaagtaggacatgtaccgccatcatgatacatcttaataactttgttatatgagtcaattttagatttaatcaagaatgcttcttgtcctatcttgttgaatgcctcagtagggtcttcgtcaagaacgatattaagtagacgctcgttagcttcttcgatttctgcttttaatgaacgagcttctttagccaggtcgtcatacatattctgtagacgcgctacattatcaccagataatttcttttgacgttcgatattctcgttataaatcttaatttgttggataataccatctttcttggcatcgagaacttgcccctgggaattaagttctcgaacttgagacttattgattttatccatttcagcgagtgtgccaacttctaaaaggtcttcgacaagttttctacgagcaggggtgctaagagccatgaaaggggtataccctgccgtcccaagcacaacgatttgtttaaaagacgcgtatgacattccgatgctacgttcaaattcttcttggaagtcacgactgctggcagattcatcaagacgaacaccgtcaacggagatttcgaaaatattgggcttttggccacgtttaatgaagtattttttaccatcgaattccatccaaagctcaactaagagctctttcttgttcgtgctattaatgatttgtcctttcttaacatcacgaaatggtttaccgaaaagtccgaaagtaatggcttctaacatcgtagatttaccaccgccatttttacctgtgattaaggtcttttggactttatctaattggatatcgataaaattttgcccaacagacattatatttttataacgaacacgatttaatttaaatgttttcacttaaatttttcctcatgaattcagaaactaaagcctgtaaagaactttgtataggatatcctaaattgactaaatttttagaaaaagtcacatatttaggtttgttcattttaacccattcaacgtaaagcatatcaaaattttcccaatgatatccttttcttctagatttcaaatgagtgtctctaactttaggatttttccaactgcgtgaaactccagccgataatgattctctatattcggctgttttagatattttacgacaagcatccaaatgtttttgtttattaatagggtcactaaaccacttttgggtcataatagagacggtttctttaaattcctttgaacttgtcataattctgtgtttctttaaattttccggatttttaaaccatgcttttaaagcttgactaatcttaattctattatcctgattggaatagtataatgtcatttttatagaattaactttacaaacattttcgaattctaaagaatacgcctcggctatattatttagttcatgcgttgtacaatttaaattaaatcgcccggtatacattctttgaagcgcgttaatcatcttgtggttgccagtttttgccaaaatgctatgtgcaataaaatggttataatgacttaaatgacacaagttccatttacatgttttaaaatctggaaaaatagattttggtagtatatggtgaacctgagtcagtccttttactttattagtggaattagtttttataaagtttaaatactcatcaagtccttcccacgaagggaaggaggttttaagaattttataaatttgagtttcataatcagtcttcgtcattatacgcgtcctcaatacatgcttcagccattttaagaatagaaccaggagtatcgttgtccattatattaaagctaaattcaatagcccagtctgtgcagacatgaactgctttaacttcattgccttcaacgcgtaatggctcgatccaatacttgatagtgttctcgaatccatcatcatctttaacgtccatttcgacttcaagcctgagtccagcattgttaaattcatctaaagtcattgtgttgcctcaatataaagttcgttggaatatttgaccagcgcttctctgtcttcatctgagatatctggaatcgcgtcaatatattctttaatgatatcttgaagtgatttaatctcgatttcctggtcgtcatcagattcaacactgttatcaactttagaaaccatacgaagagagtgaactactttttcaagttcagattcaaacttagtcaactctgaatcaatttctgatactataacacgtaaggctagattagtataatcagaataattgattttgcctttaaacggataagtgattcgtcgatgccatgttgtttcattaggaataaattccatacgttcaacatcagtgtcaaatacccagaatccgcgcgggtcgttctcatcacctgcagtaagtgtccatggtgtcccaatatatttgacgttagcagcttcagagattgtgtggaagtggccggaccagacttgtttataggtctttaagaaatcaggttcaagcccatgagacttcattcctttatagaaataaaagccattcagttcccagtgcccaacacaatacgcggcagaagaagtcttgatgtgctctaagatttcacctgtattttcttcacacatccatggaacgatatcaattagacatccgtcaaaatctacagtagttggatgttcgtaaatagtaaagttttcaaattgagttaacaattcagaaacagtgttaggtgttattgtattcttaaacgccatgtcatggtttcctatcgtgacatgaacgtgaatgcctgctttagaaatcatatcaactatttcacgattgaattccattgtacgatgtgtaattgctttacggacgtcgaaccaatcaccgtactgaatccaagttttaatcccgtgtttcttagagtattcaattgcttgacgaataccatcacgttgaatatcttgaacccatgggtcatcttgtttgactccgatatggaagtcgcctaagtgcaaaattttcatattatttcctcattagttaattcattctatcatccgtttataaagcaaaaaaaggaactccgaagagttcctatccacatagtacaccgtacagaggctcatttgaacttttaaatcgaatgggcttgtatgtaatagttccttcggctttagctttatcataagactctttaaaacgtctcattctttctgctttgcctttacggattttatcgaaattttcagaagtcgggatgttcgtcatgcataagcacctctcagaaaatgcctaaatcaatttctctcatcgtttccaccatttcttaacttgaaatgaatcgacccacacgagttgttttgggtctgcctttacaataggcggacaaatttctgtaatagaaccgtcgtgatattccttttcggaaattttaacacaaagaggaccacccaatttaatggtgaaccctgcgttcagcttcagacgtttaaactttgtttgaactagcgccattaatgatgtcctcaatagcctgacgagtagtaacccactggattttaattaacttgtcattatatggttgtcgtagaatatcccgagatttcttaatagcatattcgtaagcttcgaagttgttttgaattgctgcttcttgagcgtgagcataaagacggtttagttcaaaacgattctttttaagaatcttttcggattttttacgtgcttcagcttcatttttcttttggatttcttgtagcattttagctactgcatcttctgcttctttattttcaataatctcggtagtcatattatctcattaaattaaaataaaaacgtccatcctcttcaatacagaactcatactcaaccggagtcccatttatcgaaaatgacacgtcatgtgggttcaaagggtcgatgtcaaaattaattttaaattcacgacccaacagttttaccaaataagggattgcttcgtcaaaaggttcttctaagtagttagagatgtcaattgtcatcctcatataaaaaatccaaactaggcgaatcgctaacaacttccttcttttcagccccaggagctttataagcggattcttcataatgcgtcattttatcgtagatgtcttgaataaacgtttcatctaccaacgctaccatatcatcgtcatgactgtcgtagacgttatgaacgaagtaactatatttctttgcaacttccttacgttcttttttgatacgttggacaaaagcattaaaacaagctcgagttatgtatgcatgtgggttattgtacttagtttcgtcgaaattatgaagtcccttaatagaagcttcaatcccgtctgcaatcatctcctgcttccaagactgggtatatcctgaaaagttgaaacgtttggacaggccttcggcgataagcataattgctaaaccgatggtatcattctgacgaataattttgtttgggtctttattatttaagagctcctttttccactcgattatagcggcgagaagctctttattattcacatagttatttttaggtttttgttcagtcataagtacctcttggctcaattcataggtctattatatcataatatttagagacctatcttaaagcacgagatactatcaaagatacataactttcataaagttgtcgacgtaaaattcgcccagcttttcttcagttatagcgattcgagatagtttcattctagttcctttgctgcttcaagagcagcatccagcgaatcaaattggtcaacgaaatcaatattcaacgcatcgtcaaccgtagcatataaccaccattgtttgaattcatattccaaaataaatccaggaccttcaatctgaggaagacctaaactatttgtaccaacttcgtaaccagctagacgcaggtcattaatcaaagtttctgttaatacgctcattttaccgccttaacaattttcaagtcagcgaattttttcttacgttgatttttcatacgacggatagttttttcagagatttcatgtttctgataagctttagattcaacaccaaatgcagcaacgtcaaattcagaaagaatatattgtactagaatttcacgaatagaattacgtccaattttctggtcgtgtttttgcatgatttcataaagacggaattcccaggcgtcaagaacttgaggagtaacaatattgccagattccagaagagcaacaactttatcgaaagcgaaagaattaactacgtttttgattttagtagacatattattttcctcggttattttattatccaacgagagaattatactcatctctcaagagtttgtatactattttttaagcatgaaaagtaagtaatttgtatcacgcggagtaatatcaacacccatatcaaagatgcctttatagattgggtatttgttttcggttgtatcgaagctgaaactatttccatcacaactaacagtaatagcatctgttaaaatgtcatactcaatcctaacggttgaatcgccaattttaacgtcgaggtgttttttgaatttgataaaatctaattcttgggccacgatattttcctcattttaagacgataggaagacatgttattatcttcctaccattgtaaactattaaccgaactttttagcgcctttccagccttcgtacatagctgcacaagtcaatagcacagcatgttgacattctttgtatttgtaaatccagaaccagcgtaaaaagtcttcatcctcaacaccgttgagtttcatattggcaaagaattcggcacgttcttcacgaagttgccatgacacaatattttcaggattcattttgtgttccacgccccattttcatcgatgaacttaatccagtcatttacagaccatttagttgtatcaccctttggattaacatttaaagtatataatccctgcttaaaaagcattcgtttgatattcataatttcctcaactgtaacgataacattcgttagctttacgtttggcttcagtatgagaagtattataatcatactcttctttactgtaaacatcttttttcaacttacgaacttctttgcggagttgtcgattcatttcgttcttgacttcagaatcaacacctttcatacgtttccatttatctgagcggaagatgttttcaaccatgtctttgtggctaacaccatcaggagctttacgcttaccaaaatagtcgtaatcgcgaactttcaaatctttacgacgatatgttttacccataagtacctcagaggttgattgatacgacacgtttgataaaattcacttcacttactgaaaggtctttaagaccgattgattctaaacgctgagtaagcgtcaacatcgggatataatcccattgtgttttagtcgtttgataagtacggacgccattagcaatttcaacatgtaaatcggaaatggtaatgaataccagtcgctcgtcattaactttaagggttagaacaactttctttgagtctaaactaatcatggcttaatttccttcgcaattgaacagaagataccacggtcacaaagcatttcaccaatttctggatatttgattgaacggtaccaaacatccaggcttgaaactctggttatctgtactgcattaccgttgacagaatagtactggtcgaccttaatttctttatcttcaattgtcattttattttcctctatagtagatggtttaatcttaacacatctattgaggatgtaaactgttttatgaaaatatttttgatttgagaggggcacaaggagatagtgaagtgagggttccaatagattatattagaaatgggataaagaagaccaggcggcacctggtcaatcttctatgatatcagagtcgtatcctaatgaaatcaaggactttttaaactctgcaatattcttttgtttcttaccatttaaaaatatgacaggataacgaatattaagtgaagtgaatcctgcacgtttagcaagagatacgattaaaggacggtcatattcaatcttaccattattagtgaggactttataaaatgtataaggagcattgagctcctttaaaagttttgtaacagtataacatcctggacaacgtccaacttcttcagggatgccatagatttcaatcttgttctttaagttcgagttttgttccacgagaaataattccttgataagcccaataaggaggattaacagaatcctcaccagagttttcttcaggaaaataaacctggataacaaatccagatgcatcaaaggtaaaataaaccataggcagttcacctaacaattcggcacgagcattaattacttcgagatctcgttcacgtccagcccaaaaactaggatttagactacattcgtaaaaataatagtcattaccgaacatatcaaaccccttccaactctctaccacataccgctcaaaactaatcataattaagcctttttatcaagaacagaattcagtttattagtaattttgtccaaacgttcattgaattcgctggaggataaacccttttccggagaaattaaactaatcaagaaaaatacaacagtaaaaggaataagaaaaatagctccaactgccataaacaaaaagaacgttacagttgtaagaaaatcagctaaacctttacgaaatttatacatatttacccttaattggttaaccaagcattgataagcactaaactacactgtgaataaaattctggaccaaaatgaaaaatcatatcatttatagtatccataatataattcaatttaatcatgtttccacaccccgttggtatttgaccaaagtcgctgattatctgatcctcgccacaactttttggtcggaagatttttctcatacttaccatcaataataacatcaacatatttaagcatttctagttgtttaatatcttcaaacttatatcctgtccacaaccaaatgcttttattgggataaagatttttaatagtttgtaccacagagtgaatcacgtctctgttatcaggataaagagggtcacctccagttatagttaatccttctatataatcattattcaaacattcaattaattgttctagtgtttcaccagtgaattgaataccatttctagcattccatgttgatttattataacacccttcgcatttatgcaaacaacctgtaacgaaaagaacgaccctgcaaccagggccattcacaaaatcgcaaggataaaatctatcataattcattggtgtttaaccctatgcattatttctttatttttaccgagattaaatccgcgttcgttcggatttcccaggtagccgcatgttcttcttattgtgttcatctttttaggatcagtttctccacaaactgaacaaacaaatccgttttcagtcggagtcatttcatgggtacttccacatgtaaaacatttatctactggcatattaacaccaaaataatctaaatgttgtgcagcataatcccatacagcctcaagaccttttaggttatttttcatatcaggaagttcaacataagaaatgtgaccacctgtcgcaatgaaatgatacggcgcttcacgagaaatcttttcaaacggagtaatattttcttctactgaaacatggaaactattagtgtaccagcctttatcggtaacatcttttacgcttccatatttttcagtatcaagtttacagaagcgataacaaaggttttcagcaggagtagaatataaactaaaagcaaatccagttctttcggtccactgtttaagatgagcattcattttagttaaaatttcttgtccaatatcacgaccaacaagaatattcaattcatgaataccaatgtatcctaaagacactgaacttctaccgtttttaaataactcaattatatcgtcgtcaggtttaagacgaaccccgaatgcaccttcttggtaaagaataggagctacagttgctttaacaccctttaaagaactaattctacacatcaaggcttcaaaacacagatccattcgttcattaaatagctcaacaaatttctgttcattgaactgtgttccaatataagaatctaatgcaatgcgaggaagattcaatgttacaacaccgagattattacgtccatcaagaatttcattaccagtcgaatctttccatacgctcaagaaactacggcaacccattggagaaactggaactgaagaaccggtaatagctttattattcttaacagaaataatgtcaggatacattcttttgcttgcacactctagagcgagttgcttaatatcatagttcggatcgtctttataaagattaacaccctcttcaacaaacataacaagtttaggaaaaataggagttattccatcacgaccaagtcctttaatgcggtttttaagaattgccttctgaatcattcgttcggtccaatcggttcctgttccaaatgttatagtaacaaaaggagtttgaccgtttgaactaaaaagagtatttacttcatattcataagcttggaatgcatcgtatacgtctttttctgttttagattgagcataattcaacgcatcagcgatttgccatttttctgcatcctcaatatgttttgcataggtgcgtttaacataaggagaaagaactttatcgacattagcaaatgtagttccgccgtattgatgggaagcaacttgtgcagtaatttgtgccataattgcagtagcaacaccaatcgatttaggcgtttcgatttgagcattgcctaatttaaaaccattctcaagcatcccctttaaatcgactaaacagcaattagtaaatggaagagcaggagaataatcaatatcatgcatgtgaatgattccactttcatgcgcattcataataaaagacgggaccatatttttggcaatgtgcttagacacaataccagccataaggtcccgttgagttggaaaaacacgagaatctttattagcattctcgttcaaaagatctttattagttttataaattaatccttcaatttctttttcaattttcattttaaactctttctaagctgctttttgaatgaagctattaattgtgttttagtatcagattcattatattcaaatcctctttgaagcatctcggtcatcatttcctctttacctagtcttgagaactctttagttttgtctggaacaaaattaggatggatattattatcagaataatcttgtttcaaataagcaagaagagcttcaagccattcgaggtaatcaacgttttgacctttaagaccagaacggttgaacttatgcttcatttgaccttctgctgcattgcacaggttacatagtaaaccacgaaccttaccagcttttggcccgtttaattcgtggtcgtggtcaagatggttaccttgaacatcagggtctaattcacggtggcaaataggacacttaccattctgtgcgtcataaaatttttgtttttcttctttgtattttgcgcctgataataacatgatatacccttaccttaaatagataagggtatttattaacttaaacgtctttctaaatattcaatgtattctgcggctgcttgcatcagattaccttcatagccgtcgttattttcttgtccggctaatttagctaatgcataagaaattcgttcaccttcgaattcgccaagtccaccatcacaaactacttggtcaatttcttcgagttcatctattgaatgggattcccagaagcaccaaagacaagtatcacggtcatagatgcaaagtttctcacctgtgttcaacatcacttcgataatgccatggtcgccataaccatcttcggtagtagtaccaattaccttgatgattgttcctttctttaattcaggaaacttgtcttgtagttcttcgtcttctttaacaatcttgaaccatttaccgcgagtttcagaaatattcatatcaatattctctataaaagttacgatgagaacgtttagctttgcgaagctgacgtttagtaggacgaactgtaaatggttgtccagagaaaaaattcggatcggttttaataagcaaataccaatcatgcttgccattttttaataaacggtacaataatttaacttgcataataatctcttcccatttccatatcaattaattcatttattgaaggttcatcataacatggttcttcgtcgttgtaaacagtttcgacgtctggctcgacagtctcccatcgagcagaataccacggtttaaccccggagtttattgagctcttcataatcaatccaggattctagtccggatggcaggtcacattcaatgttccacagaagctcttcaatggcttgcaggcgattatattcttcaacggtaatggtaaccattggtgcaaccggttctgcctttttaaccattatatcgttcatcaggacgtaaaggtcatcacgaacgacggtgtcgttccaaccccatgatttggcttcgtaagctaatgatgaagggagcacatttaaaacttcaataatagttggagcatcaggaccaagttcattggcacaaacttcgtatacatcttggaaatctttaagatttaatgaatatgtcatttaaaatattctcgtagttggtcaaagccaccaatcgaagttccatcaggagcaaacacttggggcatagtcaatccgacttgtgattcacgtccaagcttaaccagaagctcagcaattttctcatcatcaaaaacacctttttctggcataacattaatgaattcaaatggctgtttcttaacagtcagcaatcgtttcgcattatcacaataaatgcatttatgaatagtagagtcgtacccgtacactttaaacattatttttcctttcatcgattaaatatgcaatgccaaatacaatacatgtaataaaacctgtgatacagatagaaaccaacaacactgtaccaaagaaccaaatcaagttatctttagtagtttgtttgatatccatctcacgaatttctatagctatcgtatcacctttattcagaagcgtataaaacgatggtgatacatgcctgtcaaaaactcgtccttgctcatctttatagactgcaataaattctaatttagaatattttcctgtagattgacctgaaattaattccactacctccacaggaattactttagtttccatgtaagtattctggctgttccaaatgaatggaataatagcaaaaactaaagctgcgataaaacaacgaaggctatatctcattataatgttctctcaaatttgtggaagcatttacggcatttcaatttcaagttatcagtggtccagttaaccagttggacttggatagttccacattccgggcatggatgttttgctgccgatttggcagcattttcacgtcgttcaaccattttcattatttcgttccatgccggaggaacgaactcttcttcaccatgaattttatctcgctgaacaaattcaatctttgaactatcatcaataaacttaactaagccatgattagtgctcatatcaatatcctctagaagacgtaggttcattataacacctcaatggcatttcgtaaaccgtccgctttcgcattcagagcttttaacgatttagtttgttctgcaatctgggcttcgacttctttcagacgagatttgaggtactcacgttcttcgctcaagttgtcaactttttctactttaggttctttaatagtcttaagtttatactcgttagggttcttcaacttaattcgggtacgagaactatataacattgatccgttatcttcggattcgtcgaacgtttcaacaacatccatagtctctaacaatgtaataagtttataagacaacgaacgaatagttttgttgtgcttattaatttcttcggctttcatggtaccgagattacgtgagtagtaataaggaacctggatatcaattgataatgatgcgttaccattaccagttggtttgaatactgcagtaacccaatctttaacatgaactttatttgtacggccatcaccgccagtgaataatttacgagaatgtttaaaaagcatattcacttgtttattgaattcacaagcaaatttatcagcaaatttagtttcaggaatggtagataaccaatcagccaaatgagtctttttaacatcattaacaatagtgaattcaaccaaatcggttttagatgtcacagatttaataaagctcggcttcataaagtttttgatgttatcacgagctacagtagaagataataaacgagaacgtttgaaccattgaagcagggtccctaatgaatgagaatacgcattctgagtatctttacagatatgattttcttggcctgtgtatgtaccaaaatcgcgaagaataccacttactacatctcggtgtggaacatcaaatcctagtgcaccaacagcgcgctgggcatgaacgttagcgataagaccggcaaagtattcaatgtaatgtgaacgtgtcataatattttcctctcgttaagatagattcattatactcaaaccatccttggttgtaaactgatttatgattttaatgcattcattgcgttaaaaagtttagagtactgcaactggagattggtcaccacctgttgagcatcacgaagcttagcttgtgccttatcaagttcagcagacagttggtctacagtagccttgatttgattgtaatgataatcttcagccggaagaaggtcattagaaacatttagttttactgccgacagtttgcacacatttggcgaacctttaaacataccagattgtgctggagaatatgcgcctagaacctctgcattaccgactggtgttgctgtaatattgccttcaaacaatgcattttcctttttaagattttgatagtattcagagtctttgtgccaccatggtgcaggaacctttttaccaatagatacacgagcctggatagcgatatggcccttattcttgataacgtcgataatattaagctcacgagaataaattgctttaatctcgtggatattatcacctaaaacttccaacgcttgatggaatacacgagcaacgttatcattcttaggtttatacgtaagagtaaactcattctcactgataaccatgatttctaacttatcgtaagtatatttcaaatgtttcatgttaattgcttgaggacgaatacgagaagcaatggccatcaaattgttaaggttatttctgaactgtttagcaaaatattgtccataaccgccaatacaaaaattacgaagtttctgtttggccagtaaacggctgaactcaccatttttaatgaactctttaacgggtgtgttagtaacacattcaaattgagtaaacttacgagaattaatcccataatacgaacagatttcctcaatctcttcaggagtctttacaggcatacggataggattaggtcctggagtatatgcgttcgaggtaaattctttgataagttctctacgtgtaatagccattttatattcctcatgttgaaaaatttattatactccaaccatccttggttgtacatcattccttaagaagttttactacttgaataagattagctcgttctgttttatttttaccgtttaagcctgctaatcgtgagatttcatcgtcagtctgttgaatagttacattaagttcgttaatcaaagcttcaaagtatttgatttgctcagcatgttttgattcaaatttctgaaccggaataacgtcttggtttagttcgtcaataaggtctttaagagcatcttcttggttgatatcgtattcaacttcttttatttcttcaacgagctcgtctttatatctaacgtcttttagtcctggagctggtcctgaaatctcttctttaagagtacaaacatacccaatacggtatccaatgccgtctcgcttgatatcaacttcgtcgataaatccacaatgtttaagaccagagccgattatgtcaaaatatccttgacgtcgtccttcaaacgttacacgaactactaagacagttttgccaccgaccttttgaagctcacatttataaaagtttgttgaacctgaataacgtggatgagttttaaagttcatctgacgatctaagcccatttgtaaacgtgctgttacagccataaaacgtgtttggttctcgttaagatgagcaacgatccatttcaaaggcattttacactgttcacgtccgaacaaatcagtacgtcctagattacgcaggatgttgttagagttaatcatcgacagaacgttaagtttattcagcgcgctgaagattccatcagccattgattttccataacctttacacgctttaataagcgctcgcggcagattagtatagatttcagacggcatatgaaaatcaaatttactagtcagtaattgatgaacttggatagcaatttgctcataattaagtgctctgcgatcgttatggtctttaaaccacactttaatctgtgaagcacataaaccgttaatttcatgttttaccgcatcagatgtaatgctcataactatttcctcagattgaattggaactcaaaaccattataacccgtccttgggtaaagcgtttatgcgtgaaccgtctttaaacgttcttcaaatttcctaagagtactaatacgttctgctttctgttttgtgtagtttgcaatacgttctgaagtgagagcgtatcgttcgtttactgtttctttcatgaagtcagggatttcacgagaagctttaatttcatcaaacttatcaagtactgcctgatcttcagcgattaaattttcgtacatctcgatatctttcttgatgaagtcgatatcttcctgggttactttggataaacgagatgctttatcctttttgtactgctcgttagtttcacgagaccagaataatgtacgttttttgttagtgtttttgtagacttccacaattccaactgaatcgatgataacaatccaattccagcgagatttgaaaatctgacctccatccacggtaatctcgttaccataagcaacatcgttaaagaacttgctttgtgcttcagatttaaatttaccgtcgttataatttaccaggttgaaaatatctttagcgttcatgttttacctccagtagttgataggtctataataacataaccatagaccttgtaaacaactaaaagaaacttttttcggtattttttccactgaaccaaacagacttcgggattttttgtaatttttcagatttaagtttctcttcctgttctttcttatatacactcttgtcgtactggagcatctctatggcattcttttgcaaacgatctaaggtaattaaggctttagtttttcctttcaaggaagagtcctggcgaacctcctcgctatattgcattgtagaactaaccatacgatgagcatagagttcgactgcagctttaattttttgcataaaatccataacatatcctctttgatttgtacatcattatttttaaatatttctatgccctcagtaggttcctggtgtccttctttgaggtaagccatatgattattcatctttatggcttttgttacctcagaacttcctataagcttatttcagtaaagttacttcggagatttcctcccaaccatctttatcagttgaaataaaatctgctacataaagagccgtacgtaatgatacattgcgaagacgagatacgttagccttcatccaggacaatgctttgtacgtttcagcatcagtcagaccacgtttctgcatcatgtcagtagataatattacgtcttcaactcgaaccataatctcttcattagagtgtactccaaggtcgagatacactgaacgagatactaaagcttgaaggtgtggggcaagtttcgaaccacgttctaactctttatcgatatcaacgtttgtaatgaaaacgatagtaccttcaaactcaaattctttatcgatacccttatcatcaagataagatgatgcagtgctccagcaaactttgcgtttatcaccggtatctaatgctgctttaagaaggttcaagatgtccatatccgagaatacgtcaacgtcgtcgattaagagaacgctgtctgcatcacggttgagccaaagttgttcgtaaagacctataccagagattttaccattaatgcttttgtatttgatgaaaccattatcattagcattactaagtgctttatccagagaatacgtcttaccaataccagctgcacctgaaataatgagtgaacgaattttgccatcgataatgccattcgtcatcatgttcattactttaaagcgtttgttgatacgagttttcatatcttcagtgctttcaacaactgcaactggtgatgtctcaactccttccattacgatgtctgatttgaagacccatactccacgttcagaaccatcaatcataacgaaaattttaccatcacctaagtgggaacattcaggattaagctttgccgggaaccatgtctttgtggcaacataagaaccagagatttcgttattacgatagataccttttttgatttgaacgttgaacattttattctcctcttgttttgataggtctataataacatatcctaaaagcatgtacactactttttaaaaatattttgaccccctaaagggacccgaaggtccccacatttacttatcgcacttagcaacataattaggcatatcacagaatacggagcgtgtaactactcgaccctttgaccatgcttcagttgcttgtccggctgtgctattaatatagcttgatttaatgttctcaataccctgagaatgtgatgcatttaccgaaccgttggaaggtgcagaagactggttaccaccagctcctgtacctatggtagcaccaacagagaatgccatcattactgcgaataaaccaattgctaattttttcatatttacctcaagttaagggttatttatctatttatagtaagaattatgattttcgagatagacttgctcaaggaagtcatcccagaaactcatatctactttttgctgcataccgttcttagcggcttgttctgatgcttgttcaacttggtcaacaatatcttctaggaattcttgtacagttttaaacgtatgtttaccaagcttaacatcgagaataaatggagcatcctgaagtgggtaaaccaggtcgccggttttgtaaatttccaataattgaagtccaccacgacatgcatgactcaatgctttccagtcaataccttcgttggcttctgccttacgagcacgttcgccatagttctcttcaagtttaaccaggatggcattgaactctttattggttaacgtgtcttggaatttacggtctaacagactatagaatgtttgcttacctgttttctcgttttcggtttcaacccatgaagcaaattcacctacaggcagaacattcttcatatgtgataaacgaattactgcaccgttatcaaagtattgtccccattcattagaacgtttaagggcttgacgaagaacagccagtcgagaacccttgacaccgtatttagaagcttgcttacggacataccctaaataagatttcatgttagtggtatagaaacgagacctgttatcttgaatatacttccatacatcaggcaaatcagatttaactactagacttggtggagtgtgaagcatatctaatgcgacggtttcaccatccgcagctagtttaaagaaatatttgagactatataactcatggtccacgtcgtcttttgtgttcttagaagatgtgttattcgtgttcttgctcatatgttctttaacgttaccggtcaaaatatcacgagcatgagggacataaatttctttaaaatcgacgtcagattcaggagtagacgttccataaaggtggctaccaaagtaagccttaacaatcgttttcattatttagccttatattcaagagtaggacagattttttctttacgagctttaaggtattcacctattaatgatttcttacgttcaataggctcaagtccatttttaattcgttcttggttttgtgcaatgagctcaatttctttataatattttctgtcgttatatttgtctaacaaccaagacggaccaattatcaacccaacagaaataagagccatgactgctacaattaaaatgcctacgccaattgaggctggaactaatgtccatagactgctaaaaacaaagaatttagttaaaatttcatggccgatgattatgactgctgctaaaatcgcaaatccaataattgaaacagccaatgccgggattaacgttttccaaaaataagcacacaacgttttcggacgattccatgtactattaaacgcggcataaattttaaagtgccaagagttttcattgataatcataataattccttatttcaaagttgggataatagaatcgagataagctttaagagcaactgcttcatctttgtctaatgtaacgatatgttgacgaaggtcatcaatttggcgaataactacaacatcgccatcttcataagaaggattaacgcctaggactgttgtatagtcagggcggtcctgatttgtaataaaagcattacggcatttagcccattgaagtttggcctttttggctgtttcagattcaatgaattctttcaccttagtgacgaatgttttccaattattaatagaaaaacattcgtcttcagtttcgatattaaccccactataaagtccgtgataaaaacgaacttgaaggtcttcattaatgttaattacagatgcatggcctggtggattgagtttcaaaatcttgtccagttccataggaagaatagtagcagcatcatcttcttgtgtcagaacatacacataaccacgtttttcgatacataaatcaccaaacaactcggttgtttcaattacagttttcatattattcaccaattaaagtttcaacaaaattcaccaaatcattcagacaagcatcaacctgattttcataaaagtcttcgttatcatttactgcatgataagctacatcattcaaatctgaatcggcttcacgtaagtcactgataaggtccatcaatttattagcttgttcacgggtcattttaccatactcgtttcaataagattcactatgccgtttaccatgttataagtaaacatcggataattgtattgtactacaacataagcgataagcaaaagtttcattttgttctccgttcgttttgataggactactataacatagtcctaccaagatgtaaactaccgattgtgttttaaatgttgataaagttcttcaacttgtttagggtccaaaacaattaagtcattttcttggcgaagataaatccatcccttatccccagggccatttttacaaaacatcaccgtcgtcatatcatcatcttcagcgctttcaggtaaaagttcaagtacaccgtcttcagattttccagtataatcgtaaagcataatgtcctcacataatctcgttaacatacatttgcaattcggtgtgggcgtcggccatctttttcatagctctgttaatgtcgatgtctccatcttcgcaaccatgagcattttcccaatcagataccgcattagcgtactcttcaatcaaaaacatcaacttagaaatcttttctttacgtgtcataacgttctcctctagtaagtaaggactactataacacaacctgaggaaaagtaaactgctaaatgccaaaaagccccaaccataaggaaggggctagtaaattagatagatgtaggctctaattttattttcatgaactcggcaaattgtctggcagtttttatgccttgttcatgacattcaaatgcatcatcacaggggctatttttgtaatgctttgccatatacttatagaatttttcagaattctcgacattttgaatttcaaacaaagtatatacgtttttaatccctgattccataaagttatcaaaatatgggtcaatatgtgcagtaccaacgataggagttgttgctgcaaaaaaccccagcatcgccatgacagctatcgctcttaaggccatataggcctcctgttaattttggccagtatttatttttcgcctttggacggccttaacatctgtgaggtatttttccagcttgcgcttgcgtgtataatcagctttagaaccagtttgacggatatcctcgtttaaatgagaaatagaatgtcctaattctcttcggatttcatccaattgggttacagtaagattacgaagttgtctttcgtttaattgctgcatatatacctcttggttagatattagtatttataacaaccctgtcaaatcattccaatgcttccggcataatgacacgtatctatcggtatcaccaatttcaatttgactgccatctgtaattggaagtccatcttccgtgactctagctaccattgtggcctttttaccgcaatgacagacacctttaagttcaacaagcttatcggcaatagccattaatgcttgagaaccttcaaatagattacctttaaaatctgttcgtagtccatatgccattaccggcacattgtatacgtcaacaatacgactaagttgatacaccttttcagtagttaagaactgagcttcgtcaacaaatacacagtgaatatccttttgtgctgcagcccatttatagaattcaaagatatccatgtcttttgtaattatattggcatcttgacgaataccaatacgagagactatttcaccttttgaatcacgagtatcaatagccggtttaagaactaatacacccatgccacgttctttatagttatgtgcggcagtaagtaatgaagcagacttaccagcgttcatagcggcataggtaaaaattaaactagccataagagtccttattcggtaattcgttctagataatcatctaatgccctttgagcatcttccagttcttgtgttgcgagctgttttgccagtttagacgagaaatacgatgaatgttcccattcataagcttgttcagccaaacgtatttcattagacaaataaattatctcttctttctgttgacgagtaatcataatgagttcacataattaatgagttcttgttctttcctgtcaaatgattccaacaatgcttgatattcttcatctgttaaaggagcatattcatcgtacgcattggtggctgcttgctcatccaataggtcatggataagttcgaacagtttagctttctcttctttagtcaatttcatttagcacctgtaagaatttttgtttgactcataaccatgtcacctttaagcaatattcttctacatgttgtttacgacctttcttatcaataaaggtatattcaacgaatgttccgatgtagtctttatctacgtcatgtggactattaattggacatttagtacgacaaatgcgttcccattgacgaataattactgctttatttttaggatcaaacggatgtgggtaatgtactttcatagcaatggttcccaatcaacaatcacaatttctagtttagtggaatacgtatctaaaatttcttcgatgacatcccagtttccaccaccaatacctgcaccaattcttggcatataaattacaggctttgttatcttattctttccgaatttatttaattctattatacaattcattaaagcagagtactcaaaattaggtcccggctcaaactgtgtataaagattaaagcaataagctttatgggtcttaaaatatttttcataaaccgaataagtcccgagtttagactcgtctccgaattcggtttgaagtttatcggcttccagaatttttggataagcctttgctaattgacctgctacaccagcgcccattgtatgaaaacaattacacccatgagcaatattattacctttagaaaacagggcgacaatatcgcccttgatatagtttttaatcacttgctgcaagtcctctagtataagagtcaactagacggtccaccatagaattgcatgctgccttatctttaggttccgccaccgagcattctaatatttgccattttttatagtatcttttaattaaagtagacgccttgaacctactagacgccccatctttttctccgtctttatacgcgtataacaatttttgtgaaaaatctactttacactcttgacttttaccacagtaatcagacgccgttctgtttgtatactccgttacatcagtatatgtagtattagcaagagcgttaaatgaaaccaagccaactattaaagccaacattttggtcattcttttatttccagtagtttatttgatttaaggtaattagccttttctaggacttcagaagcatatttacttccagcacttgtcttccatcccgcattatatgaggatatagcttttcttatatccccgttatgtatatttaaccaataagaaaattcgatataagcccatctggctgaattagaccgcttagatagcattttcttaatttgggcatcagtcatattataaccaagctggttaattcttgccctcattgttggtagataattttggaacattccatacgcatggtgacctttcttatctttaagattaataccggcagatgattcctgccatagtattgcggccattatgtatccaagtcctttcttatgcatattttcatgcgttttaaattttccatccttagaaaactgttccccaaactgataagcataattcaagttatcgagttggacattactaaaagtatgctcggagctatgtgctgataacgaaagagcaaatagaccagcgagtagtgcttttctcatgtttacctctagattttaatcactgctttagaagcttttcctggtagtcgtttactgttaataatagccattctacattgaagagtcttcattttgaatgctggattttcgcgacaaactgtaagtcctaaccaaagatttccgtcagttatttctaaacggcctgggcgatattcgacaccttcgacaaaatcttcatcaacatctggacgtgccggcattgataaaaattctgcaacttctttaacatgattttttactttatgaaataattcaaaaacgtaattctcatctatttctctctggatggcacgatctaagagatgttgagaatacttgatatgaaagcctggtagcccaagagactttgcagcatcttttataccggcatttattttgcggaactccgtttcaaagattcgacgaagtttattacggcggataaaaacgtctgaattgatagtcattttgatttctcctctagctgacaggtctatagtaacacaactagaggagaagtaaactactttattgataaaatggagttaaagcccaagattctttagataccatatcggcgaaacgcctcatctcttcgatttggcgacgacgctggtcagcatagtcttcttcgccttcttccttacaatcttcaaggtcttcttcaagatactttaagtattcactacaaattttgttgaccttttcttggaagtccaataacccagtaatagtagaagccattagtatttttcctcaggtcgaaatactgcacgacaggcccacatgctggcttcttttagatgttgcttagcatacttaagagcctgcactgcatccatatcttctttggtttgttgctctgtttcattttctttcaagatatatgcttcttcaatcagagcatcaaacagcaatccaagacggacttctgcatctttaatagcgttcactttaccgattttatcgtcggtatgcggcttgtagcctttgatgtcttcaatcgacataaggaatttcctcatcggtggcaaggtcatattcgaccaattggataggctcattaataccatatccacgtacagtgatatcagttgtcggatagcttccagtaatatcacccattctaaatgcttcaatgaatgattgctcgcctgagcaactaaaccaggcggcaaaacattttaaaacatcttcagaaccttcaataattattttagccattatagactctcagtaaaggtacgagcgataacgtcgcgctgctgttccggagtcagagagttaaagcgaactgcataaccggatacacggacggtcagctgtggatatttttccggatgcttaactgcatcttccagagtttcgcgacgcagaacgttaacgttcaggtgttgaccaccttcaattttaactttaggttgatgttcaatttcaatttcacgggcattcaaaccgtagaaaatttccgggtctacaatagcgtcttctttaaaagtcttagagacaataatccgggcttgagtaccatcttcaaaataaatagtgcctttatgtgcaccttcaagaatttgatatgctttcatataacctcaattagaaaataaatttatccaagttttttctttaatcaaaaatgggtcggaattaaacgccattaaactttgagtgattaatcccttaaatggcccatcaataaattccattttgaaatgtggaatactagtcatcaaccgcgcattaggagcagtacaaagaacctgctgccctgagaacggacctttagtcaaacgatatcgtttaggtttaaaatggtaaatctcgtaattttctacaagagcccttttattgcatactgggctgttataacaatattcaaaaacttcaatagtggtcatcattgcattccaatcacaaaaaattgaggacgagcgttaccgccgatgcaatatttgcttttgcagcagggctgtactgttttaatgtggacattgtaaatcttatccatatcaggagctttaataggctcgtcaattatatacagaatacgagaaagcgttaatccacggaatttagaaccttcattgccaataaaactacgaacagaatcggtaaataaacggaatcgaatatcgtcgctagaataacgcgaaaattctttttcaatgttgccagcagaaattttagcataagctgaagtattagaaagaacaataactgttccaccatcatacagccaattagcagcaaagttagtcacagcaattgatttacctgattgtcggccgccatctaaacgaagtgtacagtactgcttgagtacgtcttcaaatggtgggacataaccgttcttacaaatttcttctactctagcatcagaatggtgtgtaaaagcattcatcagggatagataaggtccagttaaaaatgttctcatttagtttctcttaaggttgggccattccatggcgcatgaattgtccgtttctgtatttacccattaccgcacttgggctcgaccttattacaggttggcgggaatccctcatagaataatgaggtccaggttgttcccattttatttaaatgtaaataggcctatacttaggccttattaattaccacgggctgcattagcaacggcgtaagcgtactgaacattagcgtctttaaacgtacctttagaggtatctatttctgccttaaagccgcctttagccataacatcagcaaattctttacggaaagccattgcgtcaagacctttccatgatgatttatgcttggcaaattcaagacctgcgaagttgacagctttagccaatttattatcaatgacccatttacctgctttaggcacaaacttcgggcctttttgtttagagaacagttttaaattccagcgacgaaggtcactgtcggctttaacaaaagctgcgtctaagttactagcaacaacatcttcaatatgagcaaatttaagaccatcaacttcaatatttagatcgttacgccagcgaagtccttcccaagcgaaggctttaaagtcggaagcctttgtagctaagtaccgttcaataggagcagttttagggtcaaagccgtttccgccacgataattccactcgtccttattaatgccttgagcttttcctgcaaaggcctcggcgataaattctttatatgttttcatttttgttcctattcttttaatttatgttattctttagggaagtttttagagtatgcgtcataaagtttattaccgatgcgacggaagactttagctgcaaaacggttttcagggtttttaatcatgatttgcatcatgtaagttcctgcatccgaaagagcttcttcatagtacccattaatttctttaagagtcctacgtttaccaccaggaccatcaacagtaattttccatttacctgtagaagtgcggctcggtggctcaacttgttcaatccaaatataaccaccttcaacgcgttggttggcggattctgcaataaattctttatacgttttcatttttgtttccttgtttgttttgatagagtaattataccatattaatacttaagcgtaaacaatttaagctttaccgccagaaataattccgaagttgttaaaatcgtatccaatatcgtcaacatctactttaggacctttggcatctgcttcaatgataaattcttgatacattttcatttttccttagtaaattgatttaccatagtatttgtaccaagtcggacgttgagcaattttttcatctaagcgtgcttgacttatcgcaatggacgcttcggacgggacataattattacgaaattcggcaggaatgtcggaaatatcctggacagtcgtgtccttgattttgaaaccacgtttcaagcattcagctattagctcgatttgacgtaaacgtaaaaattcgagtttgtcataaaagaatgttacgtgacctgtgcctaagataaatgttggagagattttaaaatcctttacacgtttaccattttgaacatgtttacggactgcaccaaatacgcgtggtaattcacgatactcagccataagatgttggtcggtcagttcagaaacaagtgttaaattgatacgagtcataatttcctccaagtagttgatagatgtatagtatcaaaacccttggaggaagtaaacactatttttctgaagcgcctgaaatatatttttcaagacgttgtttcatcagcgagccgttcttagcgatttcttccggtttatcgcacatacgcaacagtgcttcaagcttagcgatatcgctggtacgttcaaatttgcgagtatctatcttactggcaagttcagaaatacgtgctaatagactttcagcttcaaccaaagctgcacctagcttagttgcaaatgtgtcagtagcttcgttaagaatagattctgataaaaattcactatatgttttcatatatacgctttccaagttcctgttttaaatgttgagattacgcgttttgcgcgattaggtgtctgacgataccatttagattgggcgagatttactgccgcttcatcccaacgtttctgttgaagcatacgaagagaattagtaaaaccggcgacgcctgatacgcccatttggaagaccatattgactaatgcacatcgacgaaccgcgtctaaagaatcatacaccggtttaagtttagcattacccaagattccgcgaacggctttatcgacgtcttcattaaatagcttttcagcctcatcaagggtaattgtaccgttgcatttacgaccgatcattctgtcaagttcagctttagctacggctaaagacgggttctttgttactaaatggcctatgccaatcgtccaaaagccttcagtgtctttatataaagtcagtctaagaccttcatcattacgaagcatttcaaatatattcataatacctcccacgtttataggaggtatttattacttataggagggtagtgagcaccttatataatgatttgcccattacatattcccattgagaaggtttaattaaagcgaatgcatcaaattcaggaatttgtcgtccgtctgggaatgtatgataggaattacaaacactgtttctgaattgctcgtgctctacagggatggtatataggaacagatgaatattcttattgtctgagtaatgatgttcacctaggtctttcaggaaggcagggtcatattgtgtaaacccagtttcttcttcgcattcacgaatagcggcttcaataggagattcgccaggttcgacacggcctttaggaatatcccaccgatgagctaatgcacctttagaacgagaaccagttacacgacccatgaataattctttatcttcggtaaggaaaataataccggctgatagttctttcactttatttttcttactcatcatctcggtcccatgatttggccattaattcggacataaattcttcaatgcgtgtttctttagatggactttcactattagagaccgcaagtttgtaatctgcaataggacggaacaaatcaaggtccatattaagatcgtctttgattttttcttctgacacatctttatcgtatgtgtatagataactatcacatgattccgatttaatgtaaattgctatactcatctcaaattcctgcattcggtaataaaacgttcaacttcgttattcttggcctttatcttgtctttacgttcctgtaaactacttttaacaagattaataatgatgcctatagtacctccaccaattataccaccaattatacttacgatagtagatgccaataagatagcgataatatctggtatggcaaaggcacttactttagtactaaaaaaccataccgacggtacaaatataatccatcctgttatccattggcacttattgaaaaacttttcaagatcagcttgagttgttcgtattacttcatcgataggttgatatccattaatgtatctgttcacgataatacctgctggctggtcgattttaaattcttggcaaatacgtttcactaagtaggatggacatcctgtccaatccaccgaatagtacgaaataccttcattgccgtcgtcaatattagaccaatatgttttgttaatcattaccagccttccatagggaattccagataaacttgggcattgacacgaatttcattggtaatctttttaactcggtctgtattacgagatacacgtccgaaccaacgccatccattactaattgcacgagaaccagtgtgccatgtttgccaatcaaactgaagaagagtacggtccggagcttcccatttctctagttcacctttttcaattttttcgaggacttctttgtgccactggcgatagataagttcgccatcaggaatctgactgaactctgcagttcctgttgcaaaatgagtaggacacacgtcagcgttaacaagaccaagaatatgttcagaatggtaacgagggttgtcataatcaggttgtcctgcagtaataaaatgttgaccaaccggaatatccgggcgtggtacatcatcatggtgataacctgggatagcaggataccaaccaggcatcagcatgtggactcgtgaatcaaatacaacctggtctgtgttccaatcatctggcaagttcatgatgaagctgcgagtaataggaccgccgttattataagcaaattctaaactacagttgaagaacataggctcgttcttgattttatcattagaaataccgccggcaaaaccacctactgcacgagcttgactattaaacactttagaactattcatattattttcctcgacattctttaatgaaattttctagattggtagattcaatagcttttttacgagcttctgcgtgttcttcttcagacaatttacatttataattaacccagacgttatggtcaaaactagtcgtggcatataataacaaagccccgacgaataataaaaatggtgataagaatacaaaaccaggaacaccatccatatcgtaagccttttgtaatactgcaacagaaagagctgcgtaaaaaggtgatgcaaatattgttaaaagaccaattcggttggtttcgcctaatttcataatattctcctcatgttttaataggactactataacatagtcctataattgggtaaacagttttgtgaagttatttgaaaggtttcaccatatgaaaattttctttaaaccgtttgatgtaatcatttttgccgagcttatgatacatagccactacttcataatagttctcgtatgcgtactcacggaaccatcctgacgtgattgaagtacagactttttctaatgccatcatgaaactggcttcagggttaatttcaaagttattaggaatctgagaacgttctaatgctagtacacatgattcttcgtatacaccggccaatttgaccatttccggtaatgattcgaacttctcgcgtgaggtcatgacttcagaaccatctttcatgtaaaatgtatacgctggacggtctgttagtgcaatggcttcgtgaatagtatcatggtcatacgtatagatgtcatctttaaagaatgcgcttttagaagtgtcaagaactgggtgagcatagttcaaggtttctttctggcgtttcagcataatttcagtaagttcatcgttcagtgtaacacctttaccacgaagatactgaatatggttcatagtctttaaaaagaatggattatttttcttgaaacgatgggacatcttaattgcaaggcacatctcaggagttgcccagtaaaacccgttcaaacggtctttagtcaaatttttcttggcgtattttaaaaggtcataagaagacgtgaaatcttcaggagtgagttcaccgactaattcacggacattagtgattgccggaacaatatatgcttcaaaatgagtttcgcgtccgttatgaaaacatttgaaaacctggacgtcagggttatcttggtgaacatatacacccatcatttgatttttgaatgcattccaagaaccttggtccgcaataaagtcccaatcgctatttttgatagcgctagaatcaataaggccgtgatagtgaagtgcacgagaaccaataactaacatcataatattttcctcgaatttagattacttaaatttcacgacatgcgatattatattcatcccagaggtcgtcatgtgaagcctctaccaaaggaacgattgtaccgtttatgtcttcattataaggacaaattgtacagtgcgcatcttcgaatcggatgcctttgtgttcagattttttataacgcatatcgaatatctttgcaaacttttcacgactaatagttttagcaactacttcggttccgatactttcgtaataaatcattgtagactccatttaatttgataggactactataacatagccctatcttgttgtaaactgttttagcaagaataactagatgatacccagccttgaacagtaatactattatttgataacgagattgcgtcctggagattcagacctgcgttatcttcaatccacaatgtaacttcttcacgttcttcggttgcaatttggaacaggttttccagggcagctactgccgtacgtacagcacaatctaattcacgagacatattatttccttaacaagtgtgagaagatgcaacccaaccgccatcttcaaggctcaggttgtagtcgtattggtaaacgtcggcccattcagcatagccgttttttgtacaacgttcaagatcggctttaagctgtccgggtgaatgataggttccacccataccataagctggatacaagtcgaatgttgtgttttgtttatcagcaatttctttggcagcctcaatagctgcatagatttttgctacagcttcagccagctcggtttgttctttagacataatgattccttagcacaacgcagaagacgaaacccaagcaccttcagtaataacgtaaccattaccttcacgcttaacatcgccaccattattttcaatttcatttttcatccactgagatacgatttcacccttaggataataagtacgaccgctaccataatcacctacagaaaatgatacggcatattggtctgcgatctttgttgcttcttcttcgatacgttcagcttgatttagaagtttataaattgcatctgaagcggatttggcatcattaaactctggtactttaatttcaataatcttactcattttctacattccttaataaagttttcgattgtttcattttcacgtctagctaggagttcattataactaatcatttgagaagcgtaaacctttttatttttcttgttatggtttataaaatcgtagtaaaaatagactacagtacaaaaggatgctattgatgcaaaggcttgggtataccgtaagtcctgccattggtctgtgaatccaccagtgttacctataaatcctaacacaacgccgtcaataagaaatccaactaatccaaaggcaaatcccatgccggcgctcatgataaaaattaaaatattctcaccaagagaaggccatacggttaagagttgaggcttttgcatcttatttccttaacgaattccatagcttcttcatattcatactttttaacagcttcatcatactgagcttgggcttttgcgcactgaactttccactcgcgaactcgagctctgtgatgacggccttggtgccaatatcctgcccaattaataggcattaataaaaacggtacaataagtggtgcgacgaacattaatgaaaacgctgcatcagacgatataactttattggaatctaaaatagctcctataatcataaagattaaaaatgctaaagctaaaatagggccaaatagtacttcgtttgggattaatttacgtttgtattcgtatgcccagggcttaattggcatgtacagggttggctttgacatattctctacattccataataaattgctcaaggattaaattgttagtgaaattaggactaacaaccatagtttcataaagcgcatcaatagcacttaaagcatcaactcttttaagcaaaggctcgccttcatacatagtttcagaatcgacgattaacgtaaagtaatattttttattatcgactagaacttcagtatcgatataaaacatattagacctcagaagcttatctctaaaaccataataatcttcagagcgttcgctgatatattcccattcagtgtttaaacaacaaacagaccatgtaggagcaacaaaatcggtgaatctaatatcatggtctgcaactagtttagcaatagctccgatatcatgaatcataatacctggggctaataaagattttctgctatggccagccgttttctcagtggtctcataagaagctgaccagtaccatttacgtccagttgcaacatatcgtaatgaatcaactaaagacgtaggtggatttaccttatttcggaactcttcgaacattgagtcaatatcattattttggtttcgcatgttaactcctttattatccaaaaggaggacaaaagtcctccgtattattttatttcaaagagttaatatattcttgtacatcagcagaagtggtttcgacaccagctggagtgccattgaacgtttcaacacgagtcagagtgtcttcgatatcaaccttagtcagtgcagcgatttcaattacatcatcggccgtagagataccaagggcattagctgctcgagtttcacgaatgtattcgagtttgattgccagattctgacgagcatcgtcaagttcaacaaccttacgagcaatttcaattcgcatagcggcatacccgtcagcttttgtattaagttgttcggccgttcgacgatacagaagaccaagcttagcatgcatggtaacatcttgtccttcagccaggagcttacgaatttcacgttccttagaagcggcttgcttgttcttttcattaacaagttcgcgaatacgtttttcttcattaatagatttaacagaagccgtttttagttctttgatttgggtaatcaacttatctgcagctgcgttatactgttcttcgacagtcagatttttagccatagcagtactcagtttagtgcggatgaattcaacaagtttcttcagtgtgttcatattattacctttcaattggtggtttattatccaatgagagcattatactctgctctcaagagtttgtaaattattttttaatcaaattgacataaaactcggcgtcttccgggtgcatgccttcacagtattcttcaaccatgaacttcttaacggcttcataaggaccactcagattaagctcagttgtccagaacttggaatcttggactgaatcgatacgaacttcagggtgacggttgcgaataacttcttcggtgtattcataatcaacaacatcaatactaactgtagccattttgtttctcctcttgatttgatgtgattactataacataaacttacttagatgtaaattatttcaacgtcacctttagcggctttataaccttcagcccaagatacaacagagtttttatctgaggattcaaattcaggcattggactttcaccaatattcacacaatatgtttcttcattttcatcgaaccaaataattaaagtagtcattttgtttactcctctgtagttgataagtttatagtatcaccgtccttggtgcttgtacatcattatttttaatttttccaacttaacaacttgtagtgtccttcattaacacgtggtttatcccaagaaatactaatatatgattcactgtcaatagaagtcgccgggtttttctctaccgtaagaccttcactttccagccattcaatagtatttgcgcataaatcagaagaacacctcattggaaaccggcaagatttttcacctttagctgcagtgttatacatcttttctaaaatacgcttttgcacgtttttaaaaatagtttcagcagattcttcagattttttattcagttcggtataaagactcataacattcttctcattaatagtgctcataatatctcaatcataagcccgtgtaaacaattatttcatattattgaaataatcttccgcatcaaaatcgttatcatggtaaactttggtagacgatttggcgtagccttcagcagagaacatattaatcacaactttaattgtataccactgtccatcttcattacccattactgcataggtttcatacaccgggtgttcaggtccaataactttaatatcattcactgtacgtccgaaatcttctggaacgcatttcataaagaagttgaacagttcaccgtaattatccatttcattctccaagttttttctgtatcggtagttgatagttgtatagtaccacggaagaacagggatgtaaacagttttgtgaaaaaatttttaaaaagttttgtggaattctagggcagggagaggaaattaaaaagtaggataatatattataaagggtataaactaaatgatgtgcctagagaggccctgaaaggcctagataccaaaaagccccaacctttcggaaggggctataccttgtcggggttccacctgcaaggcaagtgtttgtacgaaacgccgggattcgaacccggttattgagtagttgacgctactcaatatttttaaaaggccatatctcgaccatatccgaacattccgtcaaaaacgctactcggcttacggcaaagatatttcctcgaatcgataattcggtgcgccgtttctgctgtgatgtaaggggatattaacgaatcataaagatttattaagaccagtccttaatcagggaacatcagtccgacgacttgccggtagcgacccggcttcttattttgacatatcatcaatttgttctctacgtctacgccatagattaattacttcatcaacacattcggcgtttgatatatgacggcaataatataatgattcgcgtttctggaaccgatgttgcaatgggatttcgtttaaaaggtctttacggtcaaagtattcaaaactagttaacccagaacggtttttaaggaacttccaatgaccaaattcattttgaacatagacgtaatcggcatgctgatacagcgaattaattaacctattggaaataactgtttcacgttcgttaaaataaaacgttaaatcatgaactaccagataaacattgcctttcatattttcctcacttaaagttggtcgagacagaaggattctaaccttcaacctacggattagaagtccgttgctctatacaattgagttatgcctcgaatatatgacccagaccagattcgaactggtaacctttcccttatgaggggactgctgctaaccattgagctacagggcctaaataactttctattatgaaaggcactttagagcacctttggtaatagagggtatgaattaataataacacataattcttaaagcaaatcaaccattttaacggtcggcaaaacgatttcttcttcaatataagcaaattcgacacgttcaactacacgcaagaaatcgtaatcatagtattcagaagcatagccaagaatatcaataagaccttgagatatctcatcgcctttcacaaagaacaggtcgaatacacgtgattcatcttcttcagatttattaccgaggtcgacttcgataccaaagacctttttaatgaattccggataaagctggtctgagaacagtccttcaaccaagtattcatagattaaaagcgagcaatcactgaatggtgtattaccacaataacgttcggctttggtgctagaatgacggctcttaaatttcttcaagagatatttaaactgttggagctcatgctcttccacttcaaacaatgttttggttttatagttgtcaccatcattttcataggtagtgacatcaattacgtaacccttaggaattgtactgcctaaacaaatattcatttactcaccgtaccatattaatgtaattatattcaatgcaacgtaatttcaaaggattcttgaaaatatcatattcaagaggacctttttctgtttcaataaagaaatcaaagttcacactattaaatttgcggtcttcccaaagtaatttaacctgtgaagatgaacggtcgatgtaaaccttttcaacttcaaagtgggtcaaaataccatagtaatcgactagtgctttagctgcagctcggtcgctttcatatccattctcaacggattttaccttagcataaagaatcatgaatgttccaccatttcaaaggtatgagcatcaacaatatgataccagtcaaaattttcttctgcgtttttataaatttcgcgaagagcctcaacagtttttcctgtagcaacaaggtcgtcaataccaccaagaggataacagtcataaccagcaaacagaaggaaattaatagtttctgtaggttctggatacagaactccgttatcgtctaccacttcaaagaaagtgtaagaaggagtacaagttttaatccaggcccatgcttgagctgctgaatcaaacggattacggaataaacgacaatccgggtctttagaaggatttgcttcaaaatcagcatatacatgatatttcattttactcaccttttgcaattttatccataacgatagcgattaagccgattagaaatgctactaccaatgagatagaattttctgttgttgtcagtagtccacaaatgaatcctacaaacatcgaaaaactaaaagccattgaagcaattactacagcaacattacgaatcagttcagcgcgtttcattttatttctccatttactcatttgatttgataggactactataacatagtcctatcagcatgtaaactacttatagaagagtttttgcaataattttaagctgagctacagaaatatgcttagctttaaacagtgcagtctcttcagccggagagataacaatagtagcgccatctttcttagcagaccatccatcccctaagtaaacagtaccttttacttcttcaccatcaaccagactaatcattggtttaccctcacgtcctttatttgttttaataacttcagaagtaagggatgcttcggtcagagtagaaacgttagcaacaggtgatataaattctttataggttttcattttatttccttgaggctgtttatttgataggatgatagtaacacaccatcatccttatgtaaactgttttgtaaaaattattttagatcttcggcccaatctagttttaagggttctttgtattcacggtcgagaataaccggaatagctacatcaccactgaatgatagttggccaacgttatatgataacgttatgtgtggagtgtagtcgtcgaaatcatgagtagcacctaaagctcgtgcatactgatgacgacatctaagatattcggaatcaagaactaaaaccagtacagcgccgtcgtcagttttccatacctcaaagtgtcctgattcggcaatagaataactaccactagacgtagtatatggtatgtttacacgtgaataacaaattgttgaatgaagcttttcacgtggtactggattaggaattcttaatttacgctggaggtcttccagcgcatcaagtgttaattctgaaaacttagctgcgacgtagaggccttgtgaaaagtcctcaaatttcattattcttcttctgtggtttcagctttaacaagttcacgtactgcttctaccaggtcatcaatcttaactgattcgccagtgataccaaccagattagcgattttagcaagagcactaccaagttgctgagattcttgctggatagcagctgcttggtcttgagtatcaagaatgcgagatttcagagtaacgatttcagactgcagtttttcgatagtttcagtagacattttattaccttaagattgtttcaattttagaataaagctcttctaaagagctgtcgtttgtaataactaaatcgccttcttcaataggcaacccagcttctgtaatatgtttatcggtggattccgtaccagagcgaaccacatgaataactgtagcacccatcgctctagcggtttccatttcatggacttgacgtgtatcggttacgacatagtaatcgaaatcacttccaatataatccatatagtttaatgcaaaaagtttaacccaatacatacggtcaaataaattaacgacaacatccgtaccgagggcttgcataagacggcggattgaccatgtgtcgttgatattatttatagcttcacgcagggcttcatatggtttaatatctagatacgaatatccaccttctaacgatgataatactttaacattattaattggtaaatattgactttgcaaataaattagcgcttcttccaataattcaataacatccaacttattgagatttaatggtgtttcacggtcatatccaacgccttcaaagtattcatatttcaactctgtgaatacatcaggattttcagcatgcctacgtccccaggctattgctagagcgtctttaatcggatatgccaattgatattttacggatttaaagtttgaattgatgtaatcagcagtggtgtctttaccactacgtttgatgccgcttaaaaagattagctccataggttttcctcatataatttatgagtgattataacatacggagctagaagcgattaacgcaaagaagggtgtctagaaatggatttagattcgaccgcttgacgtggttgttgagatacaatgacttcaccatctttttctatcgtcatatacgcgtaatgaatagttgctacgcaagtaacggcagggtcagagtcttcagtgtaactaaattcaatttcactcaaatcagaaatccatggtttatagaaatttgctgtcaaaactacttctgttttattgttgtttaaaatgtgcaaagtaacaaactcaggaccatcagagtgggccgtattatggccggttatatagttattagtgctgagcatccatttatacatgttcatccaggacgtcatgtcttcatcaactataaatcgtacaataaaagggtcatattcaaatgtggtgcctgcacgcattgcacgtcctaaacccattgtgcctgtcacagtttcaacaacaggaattctcacacctggcaatggtgccgtttgggcattgagcacaaaacctgaagttcgtgtactatccgggatatccacaacaaagtttgttatatttgtttggttaaaaatctgtctcgctggacgagtcataagcacctcaaaaacgctttaataaaaatgcagtataatggttttaggtctcttccattaatccggttcaacagaatatcagacgaacggaagagaatagaattaagatttccaaacagtatttgcagagaaacgttttccttttgacataaactgttgagtaggtaacatgattatgttagcccagtctttaggagctatttctgttattgttcctctaatgtgacctggcaggtatgctttaatcattttgtcagcaccttgaaatcctttcaccttactccagtctattttcaactttgtgttattagtaatagtagttgtgctagcatattgcttcagcaattcttcaagaaactgttgacgtgctttaggtgggatatagtgcaagtttaacccatacatcaaattatgtttacctaatcctaaataaataatcaaaggatatcggtcccagtatggcagagtatctttatgtttagcatcataaacgtaagtataaattttgcctggcgtaggcttgactactttatggccttttacacttttcttaattgtttcaacaaaccacttagatgatttgttgtttactgctgcgccttcatttctaatcttttctcgtattgaactgcgaaacgagtttatcatcagaagttgacgttcttgcttattgagtttatttttaggtttagattcaagcgtttcaattttctgtgcagtcttaatagatgatgcatatctagacattgcagatgtaaacgacgagtattttattccttttgattctgcaaatgcttttgcagtgattcctttctctttagctttcttgtattctaatcctatctcaatccattttctttcattcatagactgagcaatcttaggggcttgtacgccttcagatataatttggaatatgctcataattaccccttgtatccgagttttctaagtccgtcttcggttagaactcgaaattttatatttctcttttcagcaacagctgaggcagctttccatttgtcacagttcacagaccacgtgtagatttcattcatataacgtttcttagccgcagttgtaagattcaccggtttaataggtggctgagtttctttctttggttttatttctacaaagaactcttgacctgatgcatctttcatccatatgtccatatagtatcgacgtttcttaccttcagcattacaaaaatatggaattactgctgtttcactaccccatgcaataatttctggatttttatccaaccattcgaaaaagaatttttcccagtttgaacgatacgttattttggtatggtctccacggtatttttttaaattttttgggacccatttaccagagtaggccatgttgtcctccttataaatagtattattatttataccaatttcatattggaaggagactatcttgttatttacattcttcgacccaataggatatagtgctaaaacagttgataagaatgcacctactattcctatgacagatatatttcgtaactataaagagtactttaagcgtgttgctgccaattatagattacgttcttattacattaaaggctctccacgtcctgaagaactagcaaacataatttatggaaaccctcaattatactgggtccttttgatgtgcaacgataactatgacccgtattatggttggattacatctcaggaagcagcgtatcaagcttctattcagaaatatgcaaatgccggcggagaccaaattctttatcatattaacgagaaccgtgagaaattttacaatttggtttcatatccggacgagcctttagtgtggtacgataaaggtgatgaagctcgtaagtatccgcaatataaaggacctttagctgcagtagatacttatgaagcggcagtattagataatgaaaaacttcgtaaaataaaaattgttgcaaaagaagatataaactcgtttatcacagatttgattcgagagatggagattgcataatggaaatgattagcagtagccttaattggttcgtgggtgttgtcgaggacagaatggacccattaaaacaagggcgagttcgagttcgagtcgttggtcttcatccggcacagagggcacaaggtgatgtacaaggtattcctacagaaaaacttccatggatgactgttattcaacctattacgtctgcgtcaatgtcaggtattggtggttctgttacaggtcctgttgaaggaactcgagtatatggtcatttcttagacaaatggaaaacaaacgggattgtacttggtacatacggtggaatcgtacgtgaaaagcctaatagactcgaaggtttttccgaccctacaggtcaatatccacgacgtttaggtaatgatacgaacgtattaaaccaaggtggtgaagctggttattattcgaactctaacgtaattcaagataacaacttggattatggtataaacccagatgatacagatttagcaaatattccagaagatgatgaccctaattttacaataacagaaatgttacgtcgtgacgaaggtcttcgtgataaagtgtattgggaccatctcggatatcctacggtaggtattggacaccttatcgtaatggaaaagacccgagatatgtctcgaattaataaattgttatctgatcaagtagggcgtgaagtaacaggaaatcccgggactattacattagaagaagcaacagcgttatttgagaaagaccttgctaagatgcagaaagacattcgttctaattctaaagtgggtcctgtttatgctaaaatgaacagatctcgccaaatggcattagaaaacatgtgcttccaaatgggcgttggtggtgtagcaaaattcaatactatgcttaaagcaatggccgaaggtgattggaaaactgcatacaaatctgggcgcgattcattatggttccaacagactaaaggacgcgcttcacgtgtaacaacaattattttaacaggtaatatggaatcatacggtgttcctgttaaaacacctccttcaccaggagttggtgccgatttagttactagaaataccgattcagaagacccggctggtcctcctgttccattagattcacgcatcctttttaaagaaccggaatcaagttatcgtggtgagtatccatacgttcatgctatggaaacagaaagtggtcatattcaagaatttgacgatactccaggtaatgaacgttatcgcttagttcatccaacagggtcatatgaggaagtttctccgtccgggcgtcgtactcgtaaaactgtagaagacctttatgacatcactaatggtgatgggaacttcttgatttctggcgataagcttgttaacgttggtgctaatgaaatatattataacatggcagaccgcctccatcaaatagacggcaatgacacaatctttattcgtggtaaccaaactaaaactgttgaaggcgatggaactctttacgttaaggggaatatcaaaatagttgttgacggaaatgcagatattcttgttaaaggtgatgctaaaactcaggtcgaagggaatcatgattacaccgtcaacggaaacgttaaatggaccgttaatggtaatgttgatatgactgttgccggggattgggcagaaacaatgtctacaatgagctcagtagcttcaggacaatacactgttgacggatctcgtattgatattgggtaacatatggcacaaatacttcctttaaataccgacttaggagaagacatggaaggggcgtctattgacgtcctttttactccacagttagaaacaaccgaaactttagtgtcaataaatataacagattatgaaccgacacaaggcattacggtagatggtaatcgtttatacggaacatatgaaagtgtgtttagcttttcttcggatgcattgaaataccgattaaatgatgattttgaaaccgcatcttcatgggatgatttaccaaaagatgaatccacgcagttatatttgtggagagctcctcagaatcttcgtaaagtgtttagttatacggttgaaatgatttataactaccaagaagaaagttcatcaggcggttctagaaatgactctggtacagaacctccaccggctccagtacaaaaaactcttactaaggtttatacaaaaactatagtaggaaattggagcaaatgggctcatcaattacgaaactacgtttatgtgaggccgtgaaaatgtctggcttaagttacgacaagtgcgttacatcaggtcatgaagcatggcctcctactgtaataaatgcttcccaatctaaagtgttcaccggcggtattcctgttcttgtggcaggagaccaaataacacctcatacagaaattaaaaaaccatacgagactcatggaggtgttactgaacctcgtacatctaaagtatacgtcactggtaaaaaggccgttcaaatggctgacccaatttcatgcggggatactgtttctcaggcctcgtcaaaagtctttataaaataggaattaaaatggcaaacactcctgtaaattatcaattagcccgaacagcgaatgctattcccgagatttttatcgggggcacatttgccgaaatcaaacaaaacattatcgaatggctccatggacagaatgaatttcttgattatgattttgaaggttcacgcttaaacgtattgtgcgaccttttagcatataacactctttacatccaacagttcagtaatagtgcagtgtatgaaagttttatgcgtactgcaaacttgcgtagttctgttgtacaagcggctcaagataatggatatctgccttcatctaaatccgcagcacaaacagaaattatgctcacatgtacggatgcattaaatagaaactatatcaccattccacgtggcactcgtttcttagcatacgctaaagatacttctgttaacccatataactttgtttctactgaagatgtcattgtagttaaagacaaaaataaccaatattttccacgtcttcgattagctcaaggacgtattgttcgcactgaattaacctttgataaattaaaacctatcattattcgtgataagaatattgaccgtaatttggttaagttatacgttgacggagcagaatggattaactggactcgtaagtctatggttcacgctggttctacgtcaacaatctattatatgcgtgaaacagttgacgggaacaccgaattttattttggtgagggcgaaatctctattaacacatcagaaggtgcgttaacatctaactatattggcggccttaaacctgttcagggttctaaaatcgtaattgagtatatttctactaatggtgcagatgctaacggagctgtaggattttcttatgctgatacattagctaatatcacggtaatcgatattaacgagaaccctagcaataacccagactttgttggggctgacggtggtggtgaccctgaagatattgaacgtatccgcgaattaggcacaattaaacgcgaaactcaacaacgttgtgtaaccgcttccgattatgacacattcgtctctgagcggtttggttctattattcaagccgttcaaacattcacagattcatctaaaccagggtacgcatatattgctgctaagcctaaatctggattgtatttgacttctgtccaacgtgatgatatcaaaaactatttgaatgattataacttaggaactattactcctgttgttatttcgcctgattatttgtttatcaaaatgaatatcaaagttacatatgctttgaataagcttcaagaatcagaacaataccttgaagggcaaattattaataaaattgaccgatattatattgaagatgtagaaatttttaactcatcgtttgcaaaatctaaaatgctaacttatgtcgatgatgcagatatttctattattggttcttcggctactattcaaatggttcgcgaagtacagaacttttataaaacgcctgaggccggtattaaatacaataatcagattaaagatagatcgatggaatctaatatattctcgtttgattcgcacagacctaatccagaaaatgcaaacgaaactattaaatacggtgttcgcatagtatcttctgaccgtaatgaccgtggcataggtcaagttattattggtccattcgcagacggtgatgttgttgaaaacgaaaatatacaaccttatacaggtaatgattttaataaacttgctgttactgacggacgaaacaaatactattcaattggtgaagtgaattatcctgccgattcgatttattggaacattgctaaaattgacctcacttcagaccgttttgaagttcaaacaattgaactttattccgaccctgcagatgatattatttttacaaaggacggttctttaatcgtatttgaaaatgacttacgtccccagtacttaactatagatttggagcctatttcacaatgacagtaaaagcgccagcagtcacaagtctcagaatatccaagttgtccgctaaccaagttcaaatacgctgggatgacgttggtgctaatttctactatttcgtagaaatcgctgagactaaaacggcagacggggaaataattccccctgccagctacagatggataaatttaggatatactcctaatagcaactggttcgaaagtagcttagacccattaacttcttatattattcgtgtatcaactgccgctgaaggcttcgagagatccgattgggtatataccgaaatatttgaatcatttcagactaacgcgtatacatttcaacatatgattgaaatgcaattggctaacacttttattagagaaaaatttacaaataacaacatggcttatgtcgattttaataacgacactataatggcagctctaatgaatgaatcgttccaatttagccctgcttatgcggatatttcatctattaaaaatttcattattggtgaaaatgagtatcacgaaattcaaggttcgattcaacaggtgtgccatgatataaaccgtgtttatttgatggaatctgaaggaattctttatttgtttgaacggtatcagcctgtagttaaagtctctaatgataagggacaaacctggaaatcggttaaattgtttaatgaccgtgtaggataccctgtatcaagaacagtgtattaccagacagattacaccacgtatgttcttgggtatgataaattattttacggccgtaaatcaacagatgttcgttggtctgctgatgatgtgagatttagttctcaagatataacatttgctaaaattggtgaccagttaaatttaggatttgatgtagaaatatttggtaactacgcatcattacctgctaacgtatcacgtattgcagaagctatcgtttgcaatgacgattatgtatatgttgctgctcgagataaagttcgttttattaaaactagtaatgcccctattgattcagacccgttatctccgacatattccgaacgtttgtttgaacaagaaacatttaacatcacaggtaaccctaaggcagtttgctataaaatggattctgtcggtggtaaaatatttgcactgattatcggtgaagttgttaatcttaatgacgacccaaggaccactcctattgttgattctgctgataagggtgtttacgttctagaccatgatgctggcacatttaaacgtgtgtttggtaatactgaagaagaacgccgtcgtattgaaccagggtacaccagtatgtctactgatggtgttgagttatctatttcatctagtaattttaaatttctagaatcagatattgttgatgacccaaaaacacaagtcaagtacggtttaatcggtgctgttaaatatgagtatcctcgtgaatggctggctgataaacattatcatatgatggcatttatttcaactgaagactctcaatgggaatcgttcactcctcaacctatggaatactacgctgagccattctttagttattctagaaagtctggtactcgttgttggattaataactcagacaaggccgttgtaatttattctgatttactttacactaaggttattgagaatcatccacttagttcttcagaccgtgaagttcatgaatattggaaggacggtgactgtacaatagtgatgcctaacgtagatttcaccggatttaaaaaatatgcatccggcatgattttctataaatcatcaggtgagattatttcttattatgattttagttatcgtgttagagataatgtttctataatttggaagcctactaatatattcttaacagcatcattacaaaaccaagaaaaagataccacatggactcctgtagaagagaacggtattgcagacccagatttacgaccattgctcactacaatgatgccggagtcttatcttttagataatacaaacttcgaagcattctgcgaggcttatattcagtatctttctgacggctatgggacccattataacaatcttttaaatcttattaaaaatcaatatccacgcgaagaacatgcgtgggaatacttatggtctgagatttataaaagaaacatttacttaaacgccgaaaaacgcgatttagtgtctcgtttctttgaatcaagaagttatgacttctattcaactaaaggaactgaagcatcatataaattcttgtttaaagtgctttataacgaagatgttgaaattgaaattgaatctagttccgggaccgaatatgatatcatcattgaatctgattcgttgacagaagatttggtcggacaaaccatatacaccgcgacaggacgttgtaatgtgacgtatatcgagagaagttactctaaaggtaaattacaatggaccgtaacaattcacaacctcttaggtcgtttaatccaaggacaggaagttaaagctgaaagactccctggttttgaaggtgaaattgttcgtggtattaaaggtaaagagctttctcagaacaacatcgattacataaatcgtggtagagcatactacgtaatgaagattaaatctaaacttccatcgtctcgttggaaatcagacgtattacgttttgttcatccagttggatttggatttatcgcaattacacttctcacaatgtttattaacactggattaacacttaaacatgttgaaaccattattaataaatacaaaaactataagtgggattctggattaccgactaaatacgcagaccgagtggctaaattagacccacaaggaaatgttgagtttgaccctattacaggtaaagctatatatgaaataggccctatggctggtcaagattatccattgcctgaagattataacgctgaaaacaataactctatatttcaaggtcagcttccatcagaacgacgtaaactgatgagcccgttatttgatgcgtccggaacaacattctctagatttagagatttggttgaacaacggttaatcgataatgtaggaaatccaagagaccccgtgaatccaccacaggttaaattagatgaatgattcaagtgttatctatcgtgcaatagttacatcaaaatttagaacagagaaaatgctgaatttttataattcggttggggatggagatgataagaactccatttatattacgtttggacgttcagagccttgggcgtcaaatgaaaatgaggtgggcttcgccccaccttatcctacagattctgttcttggtgttactgatatgtggacccatatgatgggcaccgttaaagttttaccttcaatgttagattctgttattcctaggcgtgattggggagatgtgcgatatccagacccttacacgtttagaattaacgatatagtcgcatgtaatactgctccgtacaacgcgacagaagttggagccggttggttaatttaccgttgtttagacgtccctgacgtagggctctgttcaatagaatctttagataataaagatgaatgtcttaaattaggtggtaaatggaccccgtctgttcgttctatgtctcctcctgaaggcagaggcgatgctaatggggttatcgaaaccggtgatggatatatttgggaatacctttatgagattcctgccgatgtgtcaattaaccgttgcactaatgagtatcttgtagttccatggccggaagaaattaaagaagaccctacgcgttggggatacgaaaataacttaacttggcaacaagatgactatggcttgatttaccgtgttaaagccaatacgatgcggtttaaagcatattttgattctgtttatttccctgaggcagctttgcctggtaacaagggttttagacagatatcaattatcacaaacccattagaagctaagaaaaatccaaatgaccctaatgttaaagcagaaaaggattattacgaccctagagacctgcaacgtcattctggtgaaatgatttatatggaaaaccgaccacctgttattatggcaatggaccaaacagaagaaattaacattttgtttatgttttaattagggagccttcgggctcccatttttgtatctataaatagaatataatatcggacaacaaaaggcagaattatggcattttttaagcaaactcctaaacaattaatcgataccggcgaaattggtaatgcctcaacaggtgatatcttattcgacggtggtaataaaataaatgacgatatcaacgctatttacaatgcatttggcgatcaacgtaaaatggccgtagcagatggaaccggacctacaggtcaaactattcatgccacaggttattatcaaaaaggaaaggcagctgattatcaaactcctattaaaccaggcactatgcatgatattgatgcttctgatggtggtgtgattgttattattgaccgtcctgaattaggtgactctgtagaattcataaactctaatgggtctatttctgttaacaatcctttaagtatccaagtaaccgatggttcgattaaaggtgttcttaataatcttgttatttccacaccttatacccatgttgttcttcgttgtgttgaaattaatgggccgacttcagtatggaattattctactgatagcatgtttggacagaaagaatctcctgttgatgggacttggagtcttacaggaaacacagtttctattcctctgttttatcgcacggattataacatggctaaattgcttgttacatgtcaatccgctgatggtagaaaaataaaaacatgcgaaataaatattctaatagatacaattaactcagaagttctttctaccgaatttgcagtaatgcgagttggtaatgtagatgaaaccgacgagattgctaatattagctttagtattattaacaactttgctactatgacgattacatccgatattattggattacgttcagcagttaaaattatctcaactcagaaaattggggtcgctcaataatgaaacaaaatattaaaattggtaacgtcgttgatgacggacaaggcgattaccttcgtcgaggtggtgaaaagataaatgagaactttgacgaaatctattatgaattaggtgatggtgaagttccttatgccgctggtgcatggaagacttatgatgcggctgatggtcttaatcttaaggctgcttggggtaaatcttatgcaattaatactacttctgggcgagtttcggtaaatcttcctaaagggacaattgcagactataataaagttattcgtgctcgtgacgtatttgcaacttggaacattaaccctgttactttaattccggcaaacggagacacgattaaaggttcttcatctccagtagaaattaacgttcagttctctgatttagaattagtttattgtgctcctggacgttgggaatacatcaagaacaaacaaattgataaaatagttagctctgacattagtaacgttgctcgtagagaatatctggttgaaacccaaggtcagaccgatttcatggatgtttttaacgggacctcttataacgttaacaacattcgcgtaaaacatcgtggcaacgaattgtattatggtgatgtattcagtgataatagtgattttggttccccaggcgctaatcctggtgaactggttgcacttgatggatttaatattagattacgccaaccatgtaatgttggggacactgtacaaattgagacattcctagatggtgtttctcagtggcgtagttcatatactcgtcgccaagttcgcattttagatagtaaattgactgctaaaaagtctattgatggaagtatttacgtcactgatttgagtacgttccgatctattccatttacagcatttggtattaatcctacagaaccacctaacccgaattcgttagaagttcgcttcaatggtattctccaagaattagctggtactgttggaactcctattttccgttgtgaaggtgtggatgctgattctgaagagtcatgcgctaatctcggtgggacatggactcaatcatatacagattatgcgattgaatatactgataatatccctagcgcaattctgtttgaccgtcaatttgaagaccaggacattattaccatcacatggtttaataacgatttaggaactcttcttgaaatggaagaaatccttgatgtcgctgatgagaaatatgtttctcaagggtctaacattgaaattaccggtgacgttgcattaaccgatttcgataaaattggatggcctaatgtagaacctgttcctaagtacgaacgtgaattctcgactatctcagcaatatttgatacaatttatcctgtcgggactatttacgaaaatgcggttaaccctaataatccggccacttatttaggttttggttcgtggaaaatttggggacaaggcaaagtattagcaggttggaatgatgacgcgtcggatcctaattttgcattaaataataatgaccttgacatcaacggtaaccctactcataccgcaggtggtactgttggtgtaacaactatcacattagaaaatgccgatttaccagctacacaaacagatgaaaaggttcttatttctgatgataatggtacggtaattataggcggttgccaatatgacccagatgcagaaggtcctatttacactaaatatcgtgaagaccatgcaaagactaacggatctcatgttccagcgcgttctataactaatattcagccatctataactgtataccgttgggtaaggattgcataatgactgtacttaatacaaaggcgggagttatttcccgtcatgctgattttttgaattacagaaaaaatccagctcaaattgatgttttaaacaaccaagctgtaggttccgtgactatttctcagttagctcgtggtttttatgatgctaacgtagaatctgcaataaatgatgtccataatatggcacgagctgatattggtactgttgtaacaaacacttcaggcatatcgcctgaaggtacagcacaagttgattattggactttttctggtgatgttctcgacgatactttggcccctggaacgccggtcgttattaacgtatttggacttgctgttaaagcaacaattggtatgactgataacgaattaactgcacaagttcgtatagctttacaagaagccattgctaatcaaatcgctatttcttcttataaagaccatccatccgaaggtaataaacttcaggtgacatatttagataaccaacgtcatgtgttgccaacatatgcttcgtttggtgtaacaatttcgcaagaaattttgtctgaagcaaaatccggatacggaacatggaatttattgggtgcccaaacggttactcttgataaccatgatactcctaccgttttctaccactttgtgagagcctcatgagtaataacaatacataccaacacgtttcaaacgaatccatttacgttgaattcgaccctacggggacgaattttccagatacagtcactaatgtccaagccgcattagctgctatttctccttcaggtgttaatggtgtaccggaagcaacaactactacaccaggaattattcaaatagctactccacaagaagttattgatggattagataataataaagctgttactccagcatcactgaatgctcgtctacaatatcctaatgcaaccgaaactcaatatggcttaactcgttatgctactgaagatgaagcagtaaccggaactattgacgatgcatcaattactccgcttaaattgaatcaaaaaatagacaatgtatttcagacaaaagtgtcaacagaagcaacaaatggtgtaattaaaatttcaacttctgctgccgcattagctggttctgatgatacaacggcaatgactccgttaaaaacgcaacaattagcaattaaacttatttcacaaattgctccaaataatagtgacgccaccgaatctattacaggtgttgttcgtttggctacagttgctcaagcacaacaaggcaccctgcgtgaaggctatgcaatttcgccttatacctttatgaattcagtagcatcagaaactaataaaggcgtcgttaaactagggacacagactgaagtaaatagtaacaactcttcagttgtagtgaccggcgcaacattaaacgggcgtggggctacaacttctttacgtggagttgttcgtttaactacacaagcgggtagccaatcaggtggtgatggttcttctgctcttgcttggaatgctgatgttatccaccaacgaggcggacaaactattaatggcacacttcgcattaataatacgttgacggttggttctggcggcgctaatataactggtaatgtcaatatgacaggtggttatattcaaggcaatcgtattgtgactcaaaatgaattagaccgaattcttccagttggcgctattacaatgtgggctgcagatagtttaccgagttccgactggcgcttctgtcacggtgggactgtttctgcttcagaatgtccagtatatgcttccagaattgggacacgatatggtggtagttcttctaacccaggcttgcctgatatgcgtggattatttgttcgtggctcaggtcgtggctctcacttaacaaatccaaatgttaatggtaatgaccagtttggtaagcctagattaggtgtaggttgtactggtggatatgttggtgaagtacagaaacaacagatgtcttatcataaacacgctggcggatttggtgagcatgatgattctggagcattcggtaatacccgtagatcaaattttgttggtacacgtaaaggacttgactgggataaccgttcatacttcaccaatgacggatatgaaattgacccggcatcacaacgaaattccaaatatacattaaatcgtcctgaattaattggaaatgaaacacgcccatggaacatttctttaaactatatcattaaggtaaaataatggctgatatatctctggtagatttaccatatgttgacggcccgccagacgcgggtcagagtcgtattgaatggattaaaaacgatgaagaaataacaggtgccgacacaaaatacggttctgaaggtgtaatgaaccgtcctattgttgaagttcaacgtaacgtagaagcgttagatgttaatattaaaactatagcatcttctttgaatacggccaatgaagatatcaaagttattcaaggtattttagatgtttctggggatgttgatgctcttgcacagataggccagaacacccaagatatcgatgtcattaaagtcacagttcaaactcatgccagtgaattgaatgatttgaatgaacatattgatgcgaatactgatgatattggtgtttataatcaggaaacagattcagtttatagaacggttcgtaatgacctgctttggattaaaaatgaattaggacaatatactggtcaagatattaatggggttcctactccaggaaatgatagcactggtatgaaacgccgtattatgactaatagctccgtaattgttgaccacggcgttcgattaactgatttagaaactaaatttgctgattctgacgtcggctctttaactattgaagtcgaacgcttacgcgaagaaatgggacctcgtacttctttcactactccagtgtttagtcgtctttccggtattgatttaaccttgtcgcgtcaaaatgctgacttggacggcattaaacagtctattggatatcctaatacgacttctattattactaccactaatgcaaatagttcagcaataaatgacattaatcttgagctcaatcaatcaggtggtattaaacctcgtttgactacagtagaaactgccattggcgctgatgatttgcctactacaatccaaggtcgtattaaactcaatactgatgctatcggagcattgaacactgttgtcggctctgattcttcgtcaggattgcgttttaatgtgtcatggttaaataacgtagttggtgttgacgcttcaggtgggaaaccggaaccagccggctctttgctttatcgtactcgagagcttgaaggaactatcagtgggatgagtaatgacattcagaacattcaaactgatgttgggactactaccacaggaattaagggttctgtaaacacattaaatactcttataaatggcaccaacccaaatggttcgactgttgaagaacgcggtatattgcctacagttaaaagtcatgatacgacaattaatagtttaacttctagaattgctactcttgaaactgatttggccgctgcagaagctgaaatccaaactcttaaggaagctggatatattgaagatgctccttcagacggtaaattctatgttcgcaaagatggtgcatgggttgaacttcctacagcttaatgaaaagggccttcgggccctaaaggatttatatgtcaggttataatgcacaaaaccctaaagaattaaaggacgtaatattacgtcgtttaggcgctcctattgtaaatgttgaattaactacagaccaaatttatgattgtatttcacgagcgttagaactttatggcgaataccattttgacgggttgaataaaggtttccatgtattttttgttgatgacgaagaaaaataccgtcacggcgtatttgatatgcgtggttctaacgtatttgctgtaacaagaattataagaacaaatgttggctctattacttcaatggatggtaatgcaacttatccatggttcactgatttccttttaggaatggcaggtgtttcaggtggtatgggtagtaattgtggtaaattctacggccctaacgcttttggcgctgatctcgggtattattctcaattagtatcttatatgggtatgcttcaagatatgattgctcctcttccagatttttggtttaactctgcaaacgagcaattaaaagtaatgggtaactttagacaaaaagacgtcattatcgttgaatcgtatgttcgctcttatatcgagacccataagatggtaggaaatacagtagggtatggtcaggtcggtcctcgtgattcatggtctatttctgaacgttatgacaacccagaccataatttggtcggacgacgagtcggtgaagatcctgcaaccaaacaaggcgcatataacaaccgttgggttaaagattatgcgactgcattagctaaagagcttaatggacaaattcttgctaaacatcaaggtatgatgttacctggtggtgtcactgttgacggtgttcgattaattgaagaggctcgtttagaaaaagaagctttacgagaagagttatatttactggaccctcctgcaggtattttggtaggttaatatggcgacatactacagattgtatattacaacatttgaaacatccactggtataaagatttatggtggtaaacacaaatcagtttacgaagacccttcaaaagacccttatactgggtctggtacctttatacgaagggccaaaagaaaatacggtccgtcttgtataaaagaaattatatggtctaagccatttgaatctaaagctctaatggatgaagctgaagagttactggtagatgaattatccattttagaaaattgcgcaaatcttgttaaaggtggtgcaggcggaaggtcgtatattaacccagaagataatccatctataggacaaaaacgttcagcccaatctaaaaagaaaatgtctgacgccgcaaaatcaagaaaatggactgaagaagggttaagaaaacgtaaagaatctacagcaagaatgtggaaagatttcaaacatagacatcctgatttttctggttcaaaaaatccagcagctcgaaaagttagtgtaaatggtaaaatatttaacacctgcaaagaatgtggtgaagaatttaatatcacatcaagcgcggttataggccgatgcaaaaacaacaaacctaaatgggcaggatggaattatgtcgacgtataattcaaatttatttgcaaagttagaaacccgagaaggctattctaaaactaatgaaaccgagattttaaacaaatacgtgaacttcaacaaatacgaaaatagtcaaaccctagctgatgtgttagtagcagaaagcatacagatgcgcggtattgagtgtttttatgttccacgtgaatatgttgccgtggaccttatctttggtgaggaccttaaaaataaatttactaaagcatggaaatttgctgcatatctgaactcttttgaaggttatgaaggagcgaaatcgttcttcagcaacttcggaatgcaagttcaagacgaagttacattatctattaacccaggtcttttcaaacaccaggtcaacaatcaggagcccaaggaaggtgatttaatatacttcccaatggacaacagtttgtttgagattaactgggttgaaccatatgacccattctatcaagtaggtaaaaatgcgattcgtaaaattactgcaggcaagtttatttactctggcgaagaaatcaatccggtgcttcagaaaaacgaaggtatcaatatacctgaatttagtgacttggaacttaaccctgttagaaatcttgacggtatccatgacattaatatcgatgaatattctgaagttgagcaaatcaattcagaggcaagtgaatacgttgagccgtatgtagtagttaacaaccgtggtagacaaaattcaccatttgacgatgggtttatgaattaataaatagataagataaagcaaacaccggtcgaaaggccggttaggagaaatgatgtttggttatttttacaactcgtcgttcaggcgatatatcacaatgatgggcgatttgttttcaaatatccaagttaaccgtcaattgtctacaggcaataaattaattagagttcctattacgtatgcatctaaagagcactttatgatgaaacttaataaatggacctctataaactcacaagaagatgtggctaaagtcgaaactattctaccacgtataaatctccaaatggtagatttcgtttataacccaacgtttaaaacgaatatattgaataactctcttttgagtaaatcgactaaggatattgtagaccaatacaacccatcaccaattaaaatgatttttgaactgagcatctttactcgttatgaagatgatatgttccaaatcgttgagcaaattattccatattttcagccgcattttaatacgactatgattgagcaatatgggcaggatattccatttgaaagggatattaaagtcgtatggatggcagcagcaatggatgaacaaatagacggtgataatttatcccgtcgacgtttagagtggtcattaacatttgaagtaaatggatggatgtatcctccggtaggcgcagctgaaggccttattaaaacgacttatcttgattttcatgctaatgaacgagaccttcaaacagccgccagcgtttttgaatcagttgatacagaaattaaaccgagagacgttgaagcacaagattggaatggtgaagttgaacaaacttatactcatgatattccaatcccgactccaccaacccctcctggtcctagaaaacaataagaggtaaatatggaaggtctagatattaataagcttttagatatctctgacctccctggaatatctggggaggaagtagaggtatatgctcctttacaattggtggaagttcaaagtaatcctcaaaaccgcaccccggatttggaagatgactatagcgttgttcgtaagaatatgcacttccaacaacaaatgttaatggacgctgccaagatttttcttgagacggctaaaaatgccgattctcctcgtcacatggaagtatttgcaactcttatggggcaaatgactacgacgaacaaagaaatactgaagcttcataaagatatgaaagaaatcacatctgaacaggttggcactaaaagtgctgctccatctagtcagatgaatatccaaaatgctacagtgttcatgggctctccaacagaattaatggaagaagtaggagatgcttacgaggctcaagaagctcgtgagaaggtgattaatggaacagccagttaacgcattgaatgataatcacccattgaatgaaggtgacaaagttgttattctaccacctcatttagctgaacgtaaagaagaagatggtatccattggattaaatcccaatgggacggtaaatggtacccggaaaaatttagtgattatctacgtataaacaaaatagttaaaattcctaataactcagataagcctgaattatttcaaacatacaaagataagaataataaacgtacacggtatatgggtttaccaaaccttaaaagagcaaatataaaaactcaatggacttatgaaatggtcgctgagtggaaaaaatgccgtgatgacattgtatattttgctgagacatattgtgccattacccatatcgactacggtacaattaaagtacaacttcgtgactatcaacgtgatatgcttaaaataatgtcttctaagcgtatgactgtttgtaacttgtcacgccagctaggcaaaacgactgtagtagctatttttcttgctcattttgtttgttttaacaaagataaagcagtaggtattcttgcacataaaggctcaatgtcggcggaagtattagaccgtacaaaacaagcaattgaattactccctgattttttacaaccaggtattgttgaatggaacaaagggtctattcagttagacaacggttcctcaatcggtgcttacgcttcatcgccggatgcggttcgtggtaactcgttcgctatgatttatattgatgagtgcgcgtttatcccaaacttcattgattcatggcttgctattcaacctgttatttcttcaggtcgtcgttcaaaaattattattacaaccacaccaaatggattaaatcacttttatgatatttggactgcagctgttgaaggtaaatcaggatttgaaccttatactgcaatttggaactcagttaaagaacgactatacaacgatgaagatatttttgatgatggatggcagtggtctaaacagactatttcagcctcttcgttatcacagtttcgtcaagaacatactgcagcttttgaggggacgtcaggcacacttatttccggtatgaaattggctatattggattacattgaagttacacctgatagtcatggatttcaccggttcaaaaagcctgaggaaggacataaatatattgcgacgttagactgttctgaaggtcgtgggcaggactatcacgcaatgcatattattgatgttacgacagataaatgggaacaagttggtgttctacactctaatactatttcacaccttatactccctgatattgtgtttaaatatctaatggaatataacgaatgtccaatttatattgaattgaactcaacaggtgtttctgtcgctaaatcactttatatggaccttgaatacgaaaacgttatttgtgattcaatgaatgatttaggcatgaagcaaagccgtagaactaagcctgtaggttgctctacattaaaggaccttattgaaaaagacaagctcaaaataaaccatagggctactattcaagaattcagaacgtttagtgaaaagggtgtatcttgggctgctgaagaaggttaccatgacgacttagtgatgggccttgttattttcggatggttgacaactcaacagaaatttgcagactatgcggataaagatgatatgcgtcttgcatcagaagtattctcaagagaattacaggatatgaatgacgactacgccccggttatatttgttgactgtgcaagtaattcagccgaatataatccatcagcacatggcctgtcaatggtataaataaaataaagcaaattaagaggaattaaaatgtcacttctctctccgggcgttgagctcaaagaaactaccgtacagagtactgtagttaataactccactggtactgctgccttggctggaaaattccaatggggacctgcattccagattaaacaaatcactgatgaagttgcattggttgatatgtttggtactcctaatacggatacagcagattatttcatgtctgctatgaacttccttcaatatggtaatgaccttcgtgttgtacgcgcagttgaccgtgatactgctaagaactcatctcctgtagcaggcaatattgaattcacaatctctgctgctggtagtaactatgcagttggtgataaaattatcgttaagtatttgaccgaaactgttgaagcagatggttatgtcacttcagttgatgtcgatggtaaaattcttaacatttatatcccaaccggtaaaattattgctcgtgcaaaagaaattaatgaatatccggcattgggttctaactggaccgccgaagttgccagttcttcttctggactctctggcgttattacaattggttctatcgtaaccgattcgggtattctgttaactgaagttgaaacttctgaagaagctattacttctctaactttccaagaatctattaaaaaatatggtgtcccaggcgtagttgctctttatcctggtgaacttggcgaccagctcgaaattgaaatcgtatctaaagcagactacgacaaaggtgcttcagcccagttaaaaatttatcctgatggtggtactcgcgcatctactgctaaagcaatctttgggtatggcccacaaactgatgaccaatatgcaattatcgttcgtcgtaacgatgctgtagtccagagtgtagttctttctactaaacgcggtgaacgcgatatttatggtagtaatatctttattgatgatttctttgctaaaggcgcaagcaattatattttcgctacagcacaaggttggccaaaaggtttctctggcgtaatcaaacttggcggtggcttatcatctaatgaaacggttgacgctggcgatttaatggaagcttgggatttgtttgctgaccgcgaatctgttaatgcgcagttgtttattgcaggttcttgtgcaggtgaatctttagaagttgcttctacagttcagaaacatgttgtagcaattggtgattctcgccaagattgcttggttctttgctcaccgccacgtgcaactatagtcggtattcctgttaatcgtgcagttgataatctggttgattggcgtactgcgtcaggaacttacactgataataactttaatgtaagttctacttatgccgctattgacggtaactataaatatcaatatgataaatataatgatgtgaatcgttgggttccattagctgctgatattgctggtctttgtgctcgcacagacaatatttctcagccttggatgtctcctgccggttataaccgtggacaaattcttaacgttattaagcttgcgattgaaactcgccaagcacaacgtgatcgtttgtatcaggaagctattaaccctgttactggtaccggtggtgatgggtatgttctgtacggtgataaaactgccacttccgttccttcaccatttgaccgtattaacgttcgtcgtttgttcaatatggttaaaacgaacattggttcagcatctaaatatcgcctgtttgaattgaacaacgcatttacccgttcttctttccgtacagagacttctcaatatctacagggtattaaagctctcggtggtgtatataactttaaagttgtttgtgatactaccaataataccccagcagttatcgaccgtaatgaatttgtagctactttctacttacaacctgcccgctcgataaattatattacgttgaactttgtagcaacagcaactggtgccgatttcgacgaactgattggtgctgtaggtggttaataagacgcctgatgggctatttcggtagcccatataaatatactatatcgtttaaaaattaattctatgggcgtctggttaatcctaagcccatattactacagaggctaatatgtttgtagatgacgtaactcgcgccttcgaatctggtgatttcgctcgccctaacctgttcgaagtagaaatctcttatcttgggcaaaactttagcttccagtgtcgtgctacggctcttcctgctgcaatcgttgaaaaggttcctgtttcttatatgaaccgtaaaattaacgtggccggtgatcgtacattcgatgattggactattacagtaatgaacgatgatgctcatagcattcgtcagaaatttgttgattggcaaggtattgcagcaggacaaggtaatgaaattaccggtggtaaacctgctgaatataaaaagactgctatcgttcgtcaatttgctcgtgatgctaaaacggtcactaaagaagttgaaattgtcggcttgtggcctactaacgttggtgaagtatctcttgattgggattcgaataacgagattgaaacgttcgaagtaactcttgctcttgattggtgggaataatccggttggggagaaatccccagcttcccgtgatgacggagaagtccatataaatataactataattcccatttggagaatacaatgaaatttaatatcttaagtttgtttgctccatgggcaaaaatggacgaacgtgattacaaagaccaagaaaaagaaaatttagaatctatcaccacaccaaaattagacgatggcgctaaagaatacgaagtatctgaaaatgaagcacagcaaacatataatgctatgtttcagagaatgttcggtagtcaagaaccagggctcaaatcaacccgtgaattaatcgatacgtatcgaaatttgatgacgaactatgaagtggataacgcggtctctgaaatagtttctgatgctatcgtatatgaagatgatacagaagtcgtttctataaatttagacaacacaaaatttagtccaaatataaaatcaatgatgttggatgaatttaacgaagtgttgaatcatttatctttccaacgtaaaggttcagaccattttaggcgttggtatgtagattctcgaattttcttccataaaattattgaccctaaacgccctaaagaaggtattaaagagcttcgtcgtttagacccacgccaagttcaatatgtccgtgaagttattacaaccactgaagccggtgttaaaatagtcaagggttataaagaatatttcatttatgacacatcacacgaatcttatgcttgtgatggtcgcatatatgaagctggcacaaaaataaaaatccctaaagccgcgattgtttatgcccattctggtttagttgattgttgtggtaaaaatatcatcggttatttgcatcgggctattaagccggcgaaccaattaaaacttcttgaagatgccgtcgtaatttatcgtattactcgtgctcccgatcgtcgtgtatggtacgttgatacaggtaatatgccttcaagaaaagcagcagaacatatgcaacatgttatgaatacgatgaaaaaccgtattgcatatgatgctactacaggcaagattaaaaaccagcagcatattatgtcgatgaccgaagattattggttacaacgacgtgatggtaaagcagtaacagaagttgacacattaccaggtgcagataatactggaaatatggaagatgtacgttggttccgtaatgcgctttatatggctttacgtattcctattacccgtattccaagtgaccaaggtggtatacagtttgatgctggtacttctattacacgagatgaattatcatttggtaaatttattcgtgagctgcaacataaatttgaagagatattcctagacccgcttaaaactaatttaattcttaaaggaattattacagaagatgagtggaatgatgaaataaataatattaagataaaatttcatcgggatagttatttctcggaattaaaggatgctgagattctggagcgtcgaattaatatgcttcagatggccgaaccatttattggtaaatatatttctcacagaacagctatgaaagatattcttcagatgtctgacgaggaaattgaacaagaggctaagcaaattgaagaagagtcgaaagaggctcgtttccaagaccccgaccaagaacaagaggatttttaatggacgatttaattcaagctattaaatcaaacgacctcgttgctactcgaaagttttttgaaagtgcaatggcagaaaaagcggttcgtttgattgaagcgcgtaaagcagaaatcgcttctcaatttttgattgaaggcgaagaacctgaagaagaaaagaaagctaaagcttcggaagacgacgctgatgaaggcgatgacgacgaagacgaagatgatgaggacgatgaataatgtatcttatccctgaatcttatgaattggtactcgaaaatgtcgaagcacttattcctgaagcacagggccgaatcgatgcattgtcttctgctctcgatattgacgatataaatactattatcgagaacatgcttgaaactgaaacggatttagctgttgcaatggcttccattattaatgaagaacagttaaatgagtttatcgttaaacatgtttcttctcgtggtgaagtcacccgcactaaagaccgtaaaactcgtgaacgtaacgcgttccaaaccactggtctttctaaagcaaaacgtagacaaatcgctcgtaaggtcgttaaagctaaaaaagctaacccttcaggccaagttaaaggcttgcgtaagcgtaaaaaggctcttaaacgtcgtaaagcattaggattaagctaatgaataaacccgagttacttattgaaacttggggtcaacccggtgagattattgatggcgttccaatgttggaatctcatgatggaaaagattctggcttaaaaccagggctttatatagaaggtatttttcttcaggcagaggttgttaaccgaaataaacgtttatatcctaaacgcgttttggaaaaagcagtaagtgactatattaaagaacaagtcgcaaccaaacaagcccttggagaattaaaccatccacctcgtgcaaatgttgaccctatgcaagccgctatcattattgaagatatgtggtggaaaggaaacgatgtatatggacgtgctagaattattgaaggcgaccatggtcccggcgataaattagctgctaatatacgagctggttggattccgggtgtttcctctcgtggtcttggttctttaaccgacaccaataaagggtaccgtatcgtgaacgaaggatttaaattaaccgtcggcgtagatgccgtatggggaccttctgctccagatgcttgggttactcctaaacaaatatcagaatcagaatcagaaaattcggtggaaatcaccaaaaacagtgctgacgaagcatttaaagctctcgcagagagtttaaaagcattataaataataatgtaatctaaaccacaggacactaaaatgatcaaagaacaacttttgaaagaagctcagaacatcgagacttcagttgctcttaatagtgttttcgaatcagtagaactgtctccggacgttaaagctaatttcagcactgtattcgaagccaccgttaagcaggaagcagtcaaactggctgaatctcatatcaaagccatcgccgaaaaggctgaagaagaagttgaaaaggctaaagaagatgctgaagagaaagctgataaaaaattggctgaacaagcttctaaattcctggaccatcttgcaaaagaatggctcgcagaaaaccaaatcgcagttgataaaggcattaaagctgatttgttcgaatccatgcttggtggtctgaaagaactgtttgttgaacataacgttgttgttccagaagaatctgtagatgttgtagcagaaatggaagaagagctggccgaacataaagaagaaaccgctcgtttgttcgaagaagttaccaaacgtgatgcatatatcaattacgttcagcgtgaaaccgctattaatgaaagcgtaaaagacctgactgaatctcagaaagaaaaagttattggcctggttgaaggtatggattattctgacgcatttggtactaagttaactgctattgtagaaatggttaaaggttctactaaagaagaagccgatattaccgaaagtataaatacagttgacaatgacgctgccggtcttaattttgttgccgaagcagttgacactaccacaactcaggtagaacagaattctaatgtaagtttatatgcgaaagtcgcatctcgtttctaatttaaaggttaacacaaatgactactatcaaaactaaagctcagctcgtagacaaatggaaagaactgctggaaggtgaaggcctgccggaaatcgctaatagcaagcaggctattatcgctaaaatcttcgaaaaccaggaaaaagatttcgaagtatcccctgaatataaagacgagaaaatcgctcaggcatttggttctttcttgaccgaagctgaaattggtggtgaccacggttataatgctcagaatattgcagcaggtcaaacctctggtgcagtaacccaaattgggccggcagttatgggtatggttcgtcgtgctattcctaatctgatcgcttttgatatttgtggtgttcagcctatgaacagcccgaccggtcaggtatttgctctccgtgcagtatatggtaaagaccctatcgctgctggcgctaaagaagctttccatccgatgtatgccccagacgcgatgttctctggtcagggtgctgctaagaaattcccagctctggctgctgacactactactgttgtaggtgatatctatactcacttcttccaagaaactggtactgtatatctgcaagcttctgctatcgtaacacttgattctggtgcaactgatgcagctaaattagatgcagaagttaagaaacaaatggaagctggtgcactggtagaaatcgctgaaggtatggctacttctatcgctgaactccaggaaggtttcaacggttctaccgataacccatggaatgaaatgggcttccgtatcgataaacaagttatcgaagctaaatctcgccagctgaaagctgcttactctatcgaattagcacaagacctccgtgcagtacacggtatggatgctgatgctgaactgagcggtattctggctacagaaattatgctagaaatcaaccgtgaagttgttgattggattaactactctgcacaggttggtaaatctggtatgaccctgactccgggttctaaagctggcgtatttgacttccaggacccgattgatatccgtggtgctcgttgggccggtgaaagctttaaatctctgttgttccagattgataaagaagcagttgaaattgctcgtcaaaccggccgtggtgaaggtaacttcattatcgcttcccgtaacgtagttaacgtactggcttcagttgatactggtatttcttacgctgcacagggcctggcttctggttttaataccgacactactaaatctgtgtttgccggtgtacttggtggtaaataccgcgtatacatcgaccagtatgctaaacaggattacttcaccgttggttacaaaggcgctaacgaaatggatgcaggtatttactatgctccttacgttgcacttaccccactgcgtggttccgatcctaagaacttccagccggtaatgggctttaaaactcgttacggtatcggtgttaacccgtttgctgaaagttccctgcaggctccaggtgctcgcatccagtccggtatgccgtctatcctgaacagccttggtaagaacgcttacttccgccgtgtatatgtaaaaggcatctaatcttaattgattaaatcttattttgggagacttcggtctcccatttttggttttatttctgtgcaatttcgatgtaagttttcaaaatattttgccaattaggcataccttcttggacatatgccggagaaccgtctttgtttttgaatgatgcaagtttatcagtggcccaataacctttagctcgagcttcagaatcaactttcatccatactttgttgaaggcattaccattaacttttgcaccatatttttctactaacttaactgcttcagcttccagaacttttaaagtatctcgtaagaaacgtgctttagtcattttgtttactcctctgtagttgataagtctatagtatcacataccaaatacgttgtaaacaatctttataaataatctatatcacataaggaaaaatgcaatgagtaaaatccaaaaattattgcgtgaatctacaacgtctactagcaactcaatcggtcgcccaaatctcgttgctttgactcgcgctacgactaaattaatatattctgacattgtggcaacacaaagaactaatcaacctgttgctgctttttatggtattaaatatcttaacccagacaacgaattaacatttaaaactggtgctacttatgcaggcgaagctggatatgtagaccgagaaaaaattactgagctcacagaagaatcaaaagtcacactaaataaaggtgattttttcaaatataataatatcgtctataaagtgttagaagatacgccgtttgcagatattcaggaaagtgatctagaattagctcttcagattgcggtcgttcatttaaaggtacggctattttcagatgcagcggtaacaagcaaatttgaaagctctggtagcgaaatttctgatgcaagattccagattaataaatggcaaacttcagtcaaatctcgtaaacttaaaaccggcctcacggttgaattagcgcaagatttagaagcgaatggatttgatgcccctaacttcttagaagatttgcttgctactgaaatggctgatgaaattaataaagatattcttcagtctttaattactgtatctaaacgttataaagttactggaattactgacaccggatttattgacttgagttatgcatctgctccggaagcaggtcgttcgttatatcgaatggtgtgtgaaatggtttcgcatatccaaaaagagtcaacttatactgcaacgttttgcgtagcttcagctcgtgcagctgctattcttgctgcttctggttggttaaaacataagccggaagatgataagtatctttcacaaaatgcttatggattcttggcaaatggattacctctttactgcgataccaacagtccgttagattatgttattgtgggtgttgtagaaaatatcggcgaaaaagagattgtagggtccatcttttatgctccatacactgaaggaatggatttagacgacccggaacatgtcggtgcatttaaagttgtagttgatccggaaagcttacaaccgtctataggtttattggttagatatgctttatcagcaaatccttacacagtagcaaaagatgaaaaagaagcgagagtaattgatggcggggacatggataaaatggcaggacgttcagacttgtctgttttactcggtgttaaattgcctaaaattattatagatgaataaacgaaaaagggaccgtaaggtcccttttttgttatgatactaattcaatccatgcaggacgcagaacatcttgcaccattctaattaattctttcttaacaagactcgggtcattggatgatgttaatacaataccttcacgagaagtttcttctagaatatctttaacagtcaatccagtcactttaccgaaatcttttggcgttacagtcccaatcttagaaatcacattgttaacacgatttagtgtaacataacaagctagaacatcaagcaagtttttgtcaatttcagttaattgaaccttagttttaataggcttatcagactttttcttttcactgaatttagagttcttgcacttaatcgctacacgagtaccgtttggcagccatttagggaaacaaggcttcagaacataaccttctgcagtattatcaccaataacattagcatcaaatacacaattatttgcttcgacaaggtcttccgatgccgtagcgttataagcggctaagacggaatcaaggtcatttggaatcatgataagagaatcaaatgttccacgtccaagcattggtgccattttaaagccgaattcattacagaaatcttgcatttcgtaatcggtcaaatacgtattatcaccactttctgtattgataatgatatcgaacacataaaaatctttttcaccgtagtcaacacctttctggattccaccaccagcgaattcaccgaatacttgatatgatacggctcgagctgtgtacatgacttcttgaacggctttaatagccttatcatacttcttgagtacgatttcataaccataaaaatcttctgctggaagaatagggcctgtgcgcttggcgcatgtgacgttgtcacgttcaattattaacgagaagttggtcccgtggattttctcacgtgctacccaaacaccagtagtcaaaccattagtgtagagtttttcaataaacttagagttgtagtggttttcaagactgctgtatttcttaaacataaatcaccattataaataataatatcaaaataattagcagagactctatctccgacccgatgtttaatttgaatggatagaacctagattcattataccatcaaaaaatgtaaagcatattagaacttgatttctatccaatgtccatcacgttggtcgtgattaattttgtactgaaagccgttatcacgaagccattgaccgatttgctcggtgatagttaaatcattctttgacggatagtacgtgaattgtgtctggcctttgtcagcggctttctctgccatcacagagaagttagtaataaaatcactcaacaaattggccttagtggccagagccctttctcttaattcctgtgcaaaactcatttcttcacctttttgttaatcaaacgtttacggtatacaactttttcttttgctttaaactttgaccgagctgtctcggctttagtccatagtaatccaacttctttaggttgtaaaccaattttttgagcaatttctacgaatgaaaatcccgcctcatgtaatgtataaacttcaacttcagctctcataatcgatcccgtattatttggtttgtgccattatatacatcaatctcaagttgtgttttgtatgctttaaaaacgaagaaaggggccgaagccccttacgattatggatatgtatagatgataccagtttctaaagcagttttattgatgacgtatccattacgtgattcttgaacatcaacttccggatagtctttcatcatcttctgaagcgtataacgatgcaggtagtatttactatctagatcgtcaattttccaatctttaccttcttcagtcattttttggatttcatccataacccaccaaccgcaccagatgtaagctgaagtacgatgtggaagaggatgaacataaggtaattcaccttctggttccggagcaactttatcagtcacttgaacttgaccttctgctgtaatagttttgctatcatagtcatctgcagtaacgatggcagtcacttcaatagtttgacttccaacagatgaagtatcaacggtatatacattagttgacccttctacaggagaagaatctttcttccatgaatattcaatttgcgcttcttctggggcatcagtgacattaacagtaaatgtagctgaagcatcttgctgaacgttaatagaaggaggagtcaatgtaacctgtggattcattgtcttcttattaaccgttaatgatacttcattcgaagtaacttcctttgcatcataatctgtcgcagttacttgagctacacatttaattctttttactccacttgtagttggagtatagctaaatgtagagttagtttctccaccaacctgtgaatcatctacataccactgatacgtagcagacgctccagccggttgagaagctaaggcagcagtaaattgaactggggttccaattactccagctgaaggactattgggagttactgccaacgtagttgtctgagttttatttttaaccgtgatagtcgtagtaatttctgccgtttcagcgtcagtatcaggaatagtatttgttgcaacaactttaattgtttttgttccggcaggtccttttaacacataatcaaaagtttctgccgatcctacttgaggagcatcatccacagtccaagcatatgtaatagttccaccttcagtttcaccactgggagtggcagtaaactgcttagtctcatctataactccagtaggtgttttaggagttatatcaactgtaaaagccataagttatccttattttaatgttacgaaagaagaattacgagtttcacgaattaggactgatccatcgcgattaatataataaattaagctaaataatgtttggtgagcagaagcatgcacaaaactagttgggcgggatttccaatcaggtgtttcggctatccattgataaatccaccaaggaacagtaacataccctgggcctttgcctaatttaataagtgtaggactaaaattttcaggcagaacaaattttacttctttatttacctctgactcaggctctttttcagattcaacaacctgagtaattgcttcttcgaatatatcatggtcgaattctttttcttgttcgacaacttctaatacttcaacttgttctgttggagaatcaaacaacagaatagcttcttctttaacctcttcgttggtgaaattaacaccgtccacatcatctgcggcagtaattaaatcggtgatagataatccatcagtttcaggtaacggttcatcagccagtgcgttaagagcttcttcaatatcaataacaatattatcgaatgattttgttttcttaacactaatgccaaattgttccgcatattcaaacagtttagctttggcttcctttttatcggaaagagcacgtaactcttcaatatagtctttatcgatcatagtatttcctcattataaatataactatatttattacatggtaatttgacatgactgacattaaagtacattttcatgattttagtcacgttcgcattgaatgcgacgaaagtacgttttacgaacttcgtgacttttttagctttgaagctgacgggtataaatttaacccaaaatatcgctatgggcaatgggatggtagaattagacttttagattacaatcgtttgttaccatatggacttgtaggtcaaataaaaaagttctgtaacaatatgagttattctgtatggattgaccctaaaatctttgagactgaagaccttaccagggaagattttgacgcatggctttctaaacaagaaatttattcgggcaacaccaaaatcgaaccacattggtatcaaaaagatgcagtatatgaaggactagttaatcgtcgtcgaattttaaaccttccgacatcagcaggtaaatcactaatccaagcacttttagctcggtattatctagagaactatgaaggtaaaattctcattatcgtccctacaacagcattgacaacccagatggctaatgattttgttgattatagcttgtttagtcattcgatgattaagaaaattggcggtggtgctgataaagcggacaaatctaaaaacgacgctccaattattgttggcacatggcaaacggtagttaagcagcctaaagaatggttctctcagttcggtatgatgatgaatgatgaatgccacttagcaacaggcaaaagtatttcttcaatcatctcaggattaaataattgcatgtttaaattcggtttatctggctcattaagagacggaaaagccaatgtaatgcagtacgtaggtatgttcggcgaaatcttccgtcctgttagcacgtctaaattaatggaagacggacaggtaactgagcttaagattaatagtattttccttcgttatccggacgaattcacggttaaattaaaaggtaaaacataccaagaagaagttaaaattattaccggactaaaacgtcgtacaaagtggattgctcaactttcggtcaaattggctaagaaagacgagaacgcctttgtaatgtttaaacacgttacacacggtaaagaaatatttgaagctattaaagagcttggatacgaaaaagtttattacgtatcgggtgaagttgatactgaaacacgtaacgcgcttaaagtcatggcagaaaatggtaaaggcattattattgtcgcatcatatggagtattctctactggtatttcagtcaagaatcttcatcatgttatttttgcccatggtgttaaatcaaaaattatcgtacttcaaaccgtaggtcgtgtgcttcgtaagcacggttctaaagctgttgctacagtttgggatctcatcgatgacgcaggtgtaaaacctaaatcattaaatactaaaaagaagtatactcatcttaattacttgttaaaacacggtattgatcgtatccagcgttacgctgatgagaaatttaactatgtaatgaaaacaattaatttataagggcttcggcccttaggagataaaaatggtacttgaatttaaacaatttttatacgaagcatctattgacgaattcatgggtaaaattgctagttgtcataccttagaagggcttgaagaattggaagcttattataagaaacgtataaaagaaacggaattaaaagatacagatgatatttctgtcagggatgccttagcaggtaagcgtgccgaacttgaaggcgacgatgatgaggatgaggaagaagacttctaattaaaaaaaggcccgacctttttggaagggccaaaaaccataggcaaaaaaggtaacactatagtaaaagttgggtttcgttcaattgctcttctgaactttctgaaaccggcaattgttgtacataattataacaaggaccaggatgtgctggacctttgtctgtttcaacaaccaatgcagaatcgattggagttttacagacaacacaaatcttatctgacatgattgcctcctaagttgaaattacatatctatttataccattcgcatgcacatatcgatacccatatcttttgtataaaaatactcgtcgatgtacccagcaaacttccctttaatataaaggacgtcttcgccacaaggatggtctgccaggatacgaatatcctgacgacgtagatgatacttttccattaagaatttaatttcagtttcaaattcttcatcattattaaaggcatcttcaattgaataacgcattattgccccgcttcaaattctcgcatatcttggatatgtttaagtgcaaaactacgagacttaactgcgtcaagtgcaccactacagaactcaagtaaaattccccagtattgtaaagtagtctctattttaagcacatctttatctgcggccaggacagttttcatttcagatttctcatatcggtccatactgaattcatcaccatcacctcgtcccgagtagtagtctaatcttgcttttagagcagttttcttctgagtctctatacgcaacatttctttacgaataaatgagtgcttacgtagccatttgctgtataacttaacattattcgccgtctcatattgcaactttgtcgtatcaatagctaagtctgcgtctaactcttcctgtaaatcttccagcttcataatgttctctcttttaactaataatctcccggctgtatcggaaggacctaaaaccattatacataggttgccttgaagcattacactctattgcttgatgctaactgaagtttgatttgttcgatatcatcagggttatctacgaccgaaaatctaatctctactataactgtatagtcatcatatactggcattacacttacagaaagtttgtcgatgcgcggctcatagttacggacggctgcctggatattacgctcaatcgtatcagctgtaagtggtgtcatgttctcgaaaagttcatcaaccaaatcgcatccaaattcagggtcgaaggggcgtgagccttttctagttgtcactataccaagaagactatttttaatagaacgaagtcctacagaacgagcaacgtccttgttccaatccatacgcatttctgggtcgatatctgaataaagtttattgatattagacattatagtaactcaaagaattctttgaggcctcgtattgtgtgaacgtgtgacgccccacatttgggacatttaataggcgttgccagataaattgatggcgataccaaaagatttttaatattgatcatgtcatcttctgttataaggccgtaaaggtcgtttatttcggcttcagttaaatcttcaacagggatggactctccattgacaaaaacggcctcaatacatgaagcaatcattaatgcgatatttttatcgtcaaataatttaggttggcggaacttaattttaataccactaaacgaataccagggatcggcctgttcatccaattgagtatgcaataaattcatatagacttgaaatgaatgcccacaggaacaattccaggtgtgttcttgattcacttcacctaacgaatgtgcccacagatttaccaacaatagctcggcttcttgtttagtcaagtttttagcattagagcaattagtgataatattgttcactgctgattcaatagtaccggtagcccgcgcacctatgagtcctaaatattcttttaaagtaaaggctctacaattcacttctttatcgcctaaacgtacggtaaacgtatatttgtacatgttaactcctttattgtttatttataaataatagaaaaggagtaattatggctaatataattcgttgtaaattaccggatggtgttcatcgtttcaagccgttcaccgtggcggattatagagactttttactagttagaaatgacatcgaacatcgttcaccacaagaacaaaaagaaataattgccgatctgattgatgattattttaatgaataccctaaaacatggcaaccatttatattcttgcaagtttttgcaggctctataggcaaaacaaaagttcccgttattttcacttgccctaaatgctctaaagaaaaaactgcaccatttgagatatatcaaaaagaactagtcgaacctgaacttgatgttgctggtataaaaatacgtttttctttccctgaaaagttttatgacaacaaagcattaatgataagtgaaaacataaaagaagtatattataacgatgaatggtacccatggaatgatttgactgaagagaaccaaatccaagtaatagaagcaatagacattgactcactcgagaaggttattgcttctatgaaccctattaatttgacccttagattaggttgttgtgaacgtcatgttaaaacatatactgatatcttagaggtttttaaattgttagttaaccctgatgagatttttacattctatcagataaaccattcactagtaaagagtcaatacacattggattctattatgcaaatgattcctgttgaacgtggtattgctttaacattagtagaaaaggaccataaaaaatgacagtattccaacgtccaggatatcctaacttaagcgttaaattatatcaagattattcggcttggcaagaaaatagatacgttgaactcgcagcaacaataacaactttaaccatgcgagattcgctatatggaagaaatgaagggattcttcaattttatgacactaaaaacatccacactaaaatggatggtagacagatagtccaaatctctgtttcaaattcaaacacacctctccaagttagaactcgaatttacggatgtagacattattctgtgtctgtggactcaaaaggtgacaatattattgcaattgagcttggaacaatacattctatagagaaccttaaatttgggcggccattcttcccagacgcaggagaatctatacgtgaaatgttaggtgtcatatataaagaccgtacattaattactccgccaataaacactattaatgcttatgttcctgatattccttggacaagcacatttgatgattatttggcatatgtcagagaattaggacttgctacagcgagtgataagttcgtattcgtatggcaagatattttaggcgtaaacatgattgactacgatactcttattggtcaggaaggcattaagatgattgtaggcgagccaaataccgtaggtcagtatattcaagagcttgagtatccattagtatgggatttcacctggatgactaaagccaaccaatttacaagagaccctattaaaaacgccacaatattcgcccattcatttttagatacatctattccggttattgttactggcgatggtgataatgctattcttgtgtcaagatccggcggatattccgaaatgacctatcgtaatggatttgaagaagcaagtcgtcttcagacaatggctcaatacgacggttatgctaaatgcactactacaggtaattttaacataacgcctgctactaaaattatatttgttgaccaaaagaaccaattcaaatccgaattttacgtggatgaagttattcatgagttatcaaataacaactcacaaactcatctgtacatgtttaccaactcaatggtgttagaacctgttaacccagttaaggttaaaaatgaacttaaatctgattctacctctaaagaaaataattctaccacagtccaataaaaaggtaatgattcccaaattagggctcaaacattataatcttttaaaggacgttaaaggtcctgatgaaaacatgaaaatcttagctgattctatttgtaaaaatatgagtcctgctgattttgattttgcatgtctacatatattggaatttaataacaaacttaagtctgaagttgaaaaagacggattcacatataaactagatgacgtctatgtatgccaacgaacagaattccaattccaaggcaatactttttattttagacctccaggcaaatttgaacaattcgctacaatcagtgaaatgctatcaaattgcttaataaaagttaatgacgaagagaaagaaatttctttccttgagatgcctgcttttgtaatcaaatgggcagaagacctttcgacaactattgctattccaggccctaatggtcctattaagggtatagcagaaattattggattgcttgaatgaaacctgaagaaatgaaatccatgcgtagaaataaggtcattgccgataataaaccacaaaaagtagctgcaacagcagctaccgattcattagaagcattgaatgatatttcatcaaaactagacgatgtccaagccgcgtctgaactcacatcgcaaagtgtagaagataaaggcaatggaattattgaatcaattggagacttaaagaattcgacagataatactgctgaaggcacagagcttatcgcagaagttattgaaaaacaaactgaagtcactaaaagtataaatgaagtttctagtgcaataagctctaagttagaccgattagctacattattagagcaaaaattacaaacatctaccgctattcaaaatacaggaggcacctctcttgaagtaattgagaacgcgatacctgttaaagtggttgagaacgaaacttctgatgagttgtttaaagcattacctacacctgaaaagattgataataagccagacgaagatttcttcccagccccggttcaagaaagtgctaattctacttccgattctaaaggtggaattagctttaaattgagtgataaaattgcaatgctcaccaaaacagttcaagccgggtttaataaatcaatatcaatttcagacagaattgctggaatgcttttcaaatacactataacggctgctattgaagcagcaaaaatggccgcacttattcttggtattgttatcggtattgatttattgatagtccatttcaaatattggacagacaagttcacttctgcctgggatttatttgatgaaaactttactaaattctctgacgaagctaaagagtggggtaaattcttaagtgatatattcacttctattgactcgataaaacaattgtgggaagctggagactggggtggtttaaccgttgctattgtcaaaggtgtaggaacagcattaatgaacttaggtgaactaattcaattaggaatggctaaactctccgcgtctatattgcgtgctataggttttggtgataccgcggacgaaatagaaggacgtgctttagaaggattccaagaaactactgggaacaaattaaagaaagaagaccaagagaaagtcgctaaatatcaaatgaagcgtgacgatggggaattaggaaccgtttctaaaggtcttgatatgctacaacgcggcaaaacattcgttactaactgggttcgtggtaacgacaataaagaagagtttagtacaagtgatgagcgcgctgcggaatcagcaaaattaaaagagttacctgaagaggaacgtaaagaggcgtatataaaagcgaatgaaactcgtgctgcactggttagatttgaggattatatcgataaaatcgatatgactaatccggaaaatgctaaaaacgtcgagaagtcttatgctgatttaagtaaacttattaaagaccctgaacttaataaaactcctgttgttaaaaaggaaatagatgctagatttgaaaagctaaataataaaatggctgaagccaaaaaggctcagacaacagttaagcctgaatcttcgactaaatctccggaagcaaaacaagttcagtcaatagagaaaggacgtgcttctgaatctaaacaacagcaaccggtagcggcgattagtaacacaaataatgtcgtcaaaaagaataccgtagtccagaatatgacccctgtaacaagtacaacggctcctggaattttccatgccaccggtgttaattaaggattattatgattagtgtaaaagaaatagtagtagatgcaaaggatttaaataaagcaatcccagtctcagaaagtgctgggcaaagcactaaaaccgaaacaactactaaaacttatgttgctcaatttcctacaggaagagcagccggaaatgactccacaggagacttccaggtaacagacctttataagaatggattattatttaccgcgtacaatatgtctgcacgtgattcaggatccctcaggaatttacgtccggcgtatgccgggacttcatctaatggtatcatatcagatttaactgataatgtgaaagatgcggtgactaaattctcaaatggattgcttcctgccggagctaataagtctactataaataaaactcctgttgctaatatacttttgccacgttccaaatctgacgttgatacaacttcacatcgttttaatgatatcggtgatagccttattactaaaggtggaggtactgctacaggtgttttaagtaacattgcttctactgcagtttttggtgcattagattctattactcaagggcttatggctgataataacgagcagatttatacgacttctcgtagtatgtatggcggtgctgagaaccgtactaaagtctttacatgggatttaactccacgttcgactgaagaccttatggctattataaacatttaccagtattttaactatttctcatatggtgagaccggtaaatcacagtacgcccaagagattaaaagttatttagacgaatggtaccgttcaacgtttattgagcctatgacgccagatgatgcagtaaaaaataagacattgtttgaaaagattactgcgtcattaacaaacgtattagttgtaagcaaccctacaatttggatggttaaaaactttggttatacatctaaatttgacgggttaactgatgtatttggcccgtgtcaaatacaaagcgtacgttttgataaaactccaaatggacaatttaatggtctcgctgttgctcctaacttaccgtcaacatttacgttagagataacaatgcgagaaattattacattaaaccgttcttcactttatgcggggactttctaatgtactctttagaagaatttaataaccaagctataaatgcagatttccaacgaaacaatatgtttagttgtgtatttgctactacgccatcgaccaaatcatcttcactaatttcgtcaattggtagttttgcttataataacttagggttggattctgattggttaggattgtctcaaggtgatatcaatcagggcgtaacaaccctgattacagcaggaacacagaaattaattcgaaaatcaggtataagtaaatacctgattggagcaatgagtcaacgtacggtacaaagcttgttaggtgagttcacggtaggatcttatctgatagacttcttcaatatggcatataataatacaggtttaatgatttattctgtaaaaatgcctgagaaccgattatcttatgaaacggatttcaactataactccccgaacatccgaattaccggcagagaaatggacccattagtaataagctttagaatggattccgaagcatctaactttagagcaatgcaagactgggtaaactcggtccaagaccctgtaacaggtcttcgcgctttaccacaagacgtcgaagcagatattcaggttaatttacatgcacgaaatggtttaccacataccgctgtcatgttcactggatgtattcctgttagtgtctcttctcctgagttaacgtatgatggtgataatcagataacagtttttgatgtaacatttgcttatcgcgttatgcaatcaggtgctgtaaatagacaggctgctttagaatggttggaatcaggacttattagtagtgtttcaggaatgtttggaaataatcagaatgattctggtctaggaagtgcagtatcaagactttctagattaggtgggaccgctggaggtgtgtctaatataaacacattgacaggtgtggtgaattctgcgtcaagagttttaggactataagaaaaagggagacaacgtctccctttaggggtttatttacggaatgaaaggaatgctggtgctcggaatggagtatcatctttagagtatttaactaatacgaccattggtacctctgtttctaaatgacctgtcactacaccgacaaaaatttgatcagtgtgctcagggtcacgaaagtttttaagaggttccatagcaatatggaatgcacctgggaatactcgattcaattcgtcaatcacagcttcgttaaaaacatcatctgccgggataacatcttcaactactagttcttgaccattaaagcgaagcatagatttcataacgttttcctcatgttgttgatgggatgatagtatcacacatccatgtgtttgtaaactatccttggacaaatttaaacggaactgattctaaatccattaaagatgctaacaatttcaaacctttaggtgcactagttttttctacaaatgaggagaacgataccggctcatctgattcgatttcacccgtcatagcaaccacctcgcctgtttccatgagaacatcgccatcataaatgacggcttcatccaactggtctgaggacatgacttcagcttgaataaatttaaggttggattctaaacctgcaccagtatcagatgacgcatctgtaattttatttatctgcaagagaatgcctctaggcaaaataatttcttgctcattagggtgattactcaactgtcctggataaatcacgttaactttatgggcgccatcaatagcccatccaacgttaacacggatttgttctggtgcatgcatagctgttcttacttgactaggagaaatagtaacaccttcgtcattattgtcaatgttaagctctttgcgaacttcttcaggagcaagtccaagggcaacgttctctttaaacccgccaaaaataataggagctagtgaagtggaaacatagtttctgaagtagaataccttatttttaaccattgcttcataaataggcattctgatagactgggctctatacaacgttagtccttcaggtaaacggtctccatttaaaaacgccgaatcaagaccatcaatagcgcgtttaacttcatcttcatctgcaacatcgtaaaaatctggtttataacgacctaacaacatattattgatatcggtatacgcagaagaggcatattcacgaatagctcgtttttcagcaacagagtattgtttagggtcccgattcattgttatattaaaggtgcctctagccgattctcgtgcataagtatacatcacattagacaagaacgctgatttacgttgtttccaagttctttcagatacttcagctaaaacatcgtcaggcagttggaaattatcacgtctaaaatcttcaaaccattcgtctctaatagagtctgcaatttcgtttgcagcttcaacaaaagcggctaatgctttaacagatgttgttttttcagttttaattttcttagcaaacttttctaaagttggcttaataacactgccataagaaacttcatcagcaaatctaaaggattcatcaatacgattataaatcttattttcgatatcagcaactaaagtgccttttgctgtggacgatgcttgggctagtacgatttcatatgcttcaggaagtaattcagctgtagctgggccactaacttctttagcagaattttcgtatttctggaatagctcaccttcttggcggtcagcttctaaagattgacttgctgcaatagcgcgacgagaaattttagtacgagcaataacaggcttatctttacgtttttcttctacagcagcaatagaaccagcgatagccgtttctttggtgaccttttcgccagtctttttactcacataaacttcaccaacatcagaatctactttcgtgtacaactctgtgttaatgttagggatgcctttaatatcttcaatgttggcatttttacgaaccatcatcacataggtgtgtttacctgtgaattgatacattgcagacaatactttaaaacgaccaccagttttagtagaaactaaacgagcaagaagagtttgaagttgttgtccacgtcctttcaatttcttagtagggaatcggaacaaaactgcatccatacgaagagctttaacctgttcatacactgtattgaaaatggtgttgattgcatcaataggagcaggaccaagaccatttttcaattcggcgagattacccttttcagaaagactcataataacgacatgagcgtatttgtcaccaagtttaacttgttttacagcatctccttcggaaaggtaagagaataaacgaactacgatgtttgtatcgatatcaccaattttccagacttgtggaactttagctttagggttcaaattgacgacaggaagactgccttcagattcaaacacttcatttaattgttcagacatagtgttttccttttagtaataatttatatttatgccaaaaagagcccgaaggctcttaatccacaatcggaagcaaagtacgataaacttcaaaattagggcctttttcgtacttatcaaaattgtccataaaaatattataagaatcgttattaggaaaatctaatataatctgagagcaagaggtggaaacatctccaccatccttcttagctacaataactgtttctaaataagctttcattataaacctgtctgggaccacggtccgaatacgtcttcaaatgaatccgcttctgttttatcaaaacggaaccctttaataattggaaggaaaatacctacagtaccttcacggcctttagaatgaacccaaccattacattcgcaatcagcaatacgtccaatcaatttaccttcacgagcttcagccattaatcgttcacggtctaaatcatgacgctcatctaaaggaataagaacctttacaccatcaactgttttatgagttgtatctttaaaccctgaaccacaatcggttgtaatacgacgacaacgtgatacgagttcgacaccacctaatttgttagggtctttagagtgttcgtagtatcctacaacttctaaagcgatatcaataacttctttaaatttaattaggttcttagagcgtttgttttcccaatatgaatcacggtttttaaggataataccttcaagaccttggtcaacatattttttataaaccactttagcttcgtcaagattacgaactaactgattttcaattggctcaattcgcttaaagccttcagccatattttcaagagcagcaaaacgaacatcgtatttctgacctttaattttgccatcagaatagacttcatctaaaggaacatagtcccaggcttgaagaaccataccttccgcttctttaggagaaatagtcccttgaagagatttatttgctaaaccgtttgaagtgctacggtctgcaacttgtacttcttcagattcttcattatcaccaaataagaacgacaggtcatttcctgagctcacagcctttttaatatcaaatgaatgataaaccaattcaccgtcgattaaaaccccattagggtgtttttcacgggcttctttagtcatttccattagttcatctgctaatagggtaagaccatggtattcattaccagcacgagaaaagaattgaacaccgtcatcacgaacttcagcgaaacaacgagcaccatctgcttttaattgagcaaatgcaggccatttaatatttttagtaatcaatttctcgtcatatgcagatgctaacatctgcggttgcaattgaataagtccaggccataccttattcgcgatagacactgaagcacctacttcaaggtctcgcatcattacacgacgtagtacttctacatcatcaggtttaccgtcagcgatataacccatgagctctttaattgctgcattaccagtgagcttacgagtggctaatgtgaactcaataaaatccaacatgtcatctaattcaagaaggccatacgcttgagacctttcacctggtcctggccatttcttaatataatactgaatgccacgtgcatacgttaaacgatatacacgttcaagtaatttgttgtccttatttttcttaaggatttcctgttttgttttagtagaaccgatcgcagctatttggtttaaaatatctaaaatcatttgatatcctcgattttggttacggttctattataagccacttcatctagaagcgatttcagcgttttctgataagtggtaatccatttaccgagtccttcaacataatattctgaaatgtagatgaacccttgttcaacacactctttaaatatttctgcgtcttttactgaacgaaacaccggccagtctcgaaagaacatgttaacatgaccgtagtcacgtgtggtgtttttgccatctgtaatatcatgaactacaaacataattagcccttaacaatttatagaccaagtccatttggacgaatctaaaggaaagttttgaatcgtccaccatggctgcatatcggttggtcctggagttcgccaagtatacggattcgacggagcgccaatttgattaggccatgcacctgggcttgttgcacctgattctttaagcaaatccgccaatcgttttaaaaggtcttcacgatctgaatctgaattatgctcaggtggaatcaaacgagattcaatatcatcccacgtgtgtacacgttgtgcagtgcgaggaatatcatcacgttcaccacgagccaaccaataaatcggtacattaagaatttctgccgcatggtcacaatgatgagctaaatcgtcaacgtaacaaattacgttatattttgttttagctagttcgaataattgttcctttgaagaatcatgaccacacatcattacttcagagaaagcgcctgggaacaaagcattcaaattaaattgtctattcaatcgagcatcaattgaatcacctagcgccgtcacggctacaaaattatagtcttcttttagtttattgataactcgaagagcatcagaataaggcgctaagtaacgaataaaatcagagctattatatttttctattaattgtttaccaaggttatcgtcggtattgaacagtttaccaggagaaataaatttttcgtcctgaatcatttttaaaatatgttctaatggaagattatatttttgggcaaaataaggaagtccagattgccaacttaaacatacaccatcaatatcagtcaaaatagtaggcttcataaagagtctcttaataggtttaacacatcaacaaattcagtttcggttagtattgtatcatcttttgttaggtggctagccatgctgtgcttcaaaatttttcctttagaggcttgtaaggcatcacgaaatcccttattttggatcgctgcttcaaaatatgcatttgtgtataattctttccacgcttcagagtatcttgaaaatggaactcccaaccagaagagggtcccacggtcctgagctcttgcataagaccttccagcttgttgggcggcaagcccggatagtccaaatatacgtctttgttgttcaacatttttcaccttacatccttggagaaacccttcaagacctccgaattgaataccgtccataacaaaaggccattgagcaaagttacttaatgcacatgacggccacttaaaattacttcttatttctaattcagacatctttaacacttataatttcaacatcagcccaatgaccataaccaggtatacgatcttcgatagataaatttccgtcatttttaggtagtttaatcgatgtgatatacggttctaaatggtcttctgtatgcggagaaacatctgtcacacgataagtaacttcaaccatttccgtaccaaacaatttctggattagtttattcaacatgtttcaaccctttaataggagataactctttacccatacgtatgtcagaagtccaatcaacccattgaacagcatacgcttcattgataattccagcggcggttttaaattcagggagaactttaaaaatcaccccaggaattccaacaccttttaattggactgtttgtgctattaaaaatttcatatttttccacttagtaaagaaatcattatactctaatccgtccttggatgtaaactacttaacgaaattaatttctaccggatgaacaacaggttgagcagtgatatattgagtaattgctttcatgactagagcttcagaaccaggatttttctcaacgaattcacgtgcttggttatgagcttcaagttcacttagtaaaccacttcgttggcatccacggtcttgagtaccctgttcagataaaaagacgacgatgtatttttcatcgtcataagatttagacggttgagcaaatgttcctttacttccgaaaggagagttatgacgccacatcacgccgtgaggagtttcaaccttcgtatattcgtgcgggccatttttcttaatttcttgatgtggaacttcatggaccttagggttaggacattcaataaaatgctcgtctaaatcggtcgagaatattaaagtaaaacaattactgaatttaccaacacctgcctgataaattttaccttcagaagttctaatttcacaaactgagccggcatcagtaacttctaaaacttcaaaaggctcgataaggtcatatgagaacatgtttttaaggcgtggagtaatatccccatttttaaaattcattttataaaaagtattaactttaaacataatttcctcagtgggagccgaagctcccagttaaattagatatcgaattcattaagaactacatcaaagattgcttccaggtgttcaggtttagctcggttgctcaggatgtgacgaatccaagttttaaccagaagcttacgattaacaccgttccagcaaggatgagtacctaaatcacgctgacggaaatcgtcatctaatgcaattttgaagttggaaccttccatcgtgattgaaaccgtgatgccattttcaaatcgcatataaacgtaattaggagtcatgcactgttcgatttcacatactgaaccatttttatgtttccataagcaaataacttcagaagaaccagcgataccgttagaaacatatttacgttcgaagttgatgtagttcattttattctccagatgtttaagttgtttgttggtacaggtatataataacataacctgtaccaaagtaaactgttttatgcaactttaatccaattgtctaaatttaaaacacctttggctttcattttttcgatcaggttatctgctgtaatgcgtccattttgataccatgtaacatcttcagagtaaccagtttcttcgtcaacatatgtttctgaacgaattttacctgtaataatagtttttaattcgtatgtgtcacctgtgaaaaagtttgctaacacaattttccaagagaaatcatcagaaggaccttcaggggtcatacaacctacgaactcaaattgctctttgtataacatccactggaattctttaatttcgatagctttataaccgtcgtggtctttacatttgatgtatgagttcagattgattttcattttattctccggttgttttattgattaggtggtacaagtctatagtaacacatcctacaggagagtaaacatcttttttaaactttttctgccctaaacgcacaaaagggagaccgaagtctccctaaaattatgcaacaacctttccaaaacgagaagcatcatctcgaagaactgcacgtgctctgcgcatgatcttctcaactgtttgattaatacgagagttcgacccacgcttgtatccagcgcgtttagaggtaccatcaactttcttttcaactgctttctttgctttagcttgttttgccattataaattctctttaaatgaaaatgcaggacttattgacattgcctgcgcaagccctcaaggggaacataggttttgggtatttaacgacaggataaccataaacccgtcatcatacctaccatgacttacacagctaaccttttgctgacgcatgatagcaattatttcaaagtaataacaaaatgacgaactgctttgcgtgctgcagaagccagaggcttagcatatttcaattcatctttagcttccagttcagaagccaaagtagcctgagcaggattcagatgtttgaaatatcgcaggatttccagtgcttcggcttcaacatcaattgaagcgccgtagttttcgtgaccgttattccatgcgttgcgttgcagttcaagagcgtgttgtaattgtttaatcattttaaattctcaattcgagataatatttagtagccacgttcgtctgaatttcaccttctttcgacaagtctctcagttgtaggctaccgcttagaagagtgttctcttcatatagttatttatatcacttataaagacacggaatagctttatagtggcatgttacgaatttctgtttaatttctttaggttgtttaagtcccaaagccacaaatggatgtggaacatttcgaatttgtccaactggtagtggagtcaaatcaccaacttcaacaaaaccttcaggaacatcaggacctacagaatgaactacacatagttcaggaacttcaccttgaacacgtttaccaatcacaagtcctgattcggtaacttcttcatcacctgcttgagcgggttcagaaaccagaatgacatattcaccaacagcacgaattgggagttgtacttcagacatcttatttccttgttgtttgacgatagattaataataccatactattcgtaaagcatattacataagaagcaaacgttcgaccggagtaccatcaaccgaaattactttatcaaggcggaaagaacgccactgacctaacttggtatcgaatgctcgaactgattcacgaggttcataacgaacttctgttgctggattgttattgacatatttgacttcaagttcatcgcgcgaagcaaacatagtgcgtacatcaccgttagccttttcaaatacaacacaatgaacgcctacagacagaatagttttaatacgttcacgaagaaccatagtttcttgttcagttaaaatcatattattcaccacaaaagtttcggatttgttcccaattcagagaacgaagattattacgagagtactgaattacttcaataccagcttgttttagaatatctgcccaattttcaggagatcggtcgtataattctgcgtatacaacctttttaatacctgactgcgtaatagctttagtgcaatcaggacacggagaaagcgtagtatataacgtagcaccttcaatagaattacctttacgagcggcaaacaaaattgcattcaattctgcatggatttcattattagcagaccatgcactatgagcagctcgatgttctttggctaaaacaaaattatctacccgtccaaatgctgtagtgccttctttatgtccagcaacgatgactgggattggtttattcttcaaccaaccattttcagatgcatgttcgcaacagttaacgccacctgcaggtgaaccgttatatccagtagagataatgcgtccatctttttcaatgacggcaccaactttccatgaacaacattttgattcttgagaaatcagatatgcaatctgaaggtatgtgctagctttcattattgaaccttattaatataagttaacagctctttagtttgttcccaactgatgcacgcatcggtaacggaaacgccataggacatattatcagaaattttttgatttccttcatgtaggaacgattctatcataattcctttgaccaaatcattagctgctaaatttttaccaataccaatttgattgctataatgcccatcagcgtttgcatggctacagtcaaccattacataatgattcagacctactgcccttgctttgttagaagcttcttgaatatcagaagaatgatagttcgggccgttggtcccgccacgcaatacgatatgcgtattctgattaccttcagcttcaacaatgcctacagtaccatcgacgtccatacccatataccgatgaggccaggcggcactatacatcgcgtctgtagctactttaatagaaccattggttgcgttcttgaagcctacgcacatcggtagacctgaagcaatttcacgatgtgtctgactttcagtcgtacgggcgccaatagcaacccatgagaaaataccagaaagatacttaatcgtgaatgggtctaatacttcagttgctaatggaagtcccatacgtagaagtttacgacacaatgttcgtgcaactataagaccgtggttcatatcaaaacttccgtcaagatatggatcatttacaagacctttccaacctacggtagttcgaggcttttcaaaataaacgcgcatcactaacagaacattaggaagacgagtttgaagttcagccagacgtttgccgtattcaacagcagcaatagggtcatgaattgaacaaggacctacaacaataagtttgcgtgggtcttcaccgttcataatcgaattaacttgttcgcgatgagaagccacttgtgatgcgtaagcttccgacaaaggaataatctcagccagttcttttggagaaataagttttccgacgacaggtaacataacaatccttaggagatataaacagattctgattcaacaatacctttaaccggattagacaggctaagttggtagtgctcagatttatgaccattctcgatagtaatgagatagctctcattatagtgttccatatactcgagttgcttcaacaagaccatcactgcctaatttaaggctagtaatctggtcaccatctttaggattaacgattatgagaaaagaacgtggagattcttgaataactcgtaatgttgcatcctggaaacgttcagacactttattgatgagtgcttgagcaaattcttttactttaatctgaaattcgtgtactgtaattggggtttcacttagcatttcgatttcctcattgtgttggtagagttatagtatcacaactccaccatgttgtaaaccattaaattgctttgcattcaattttttgtgtaccgaaattgatatcacattggataactaaatcgccgtcaagatcaaataccactatgacgtgtgcagacccagggagaagagtaatagcaatagaatctacttggtctgggagtaaagcattgagtacatgagttagttgagcatgaactctgagttcggctgcattatcaagcacttcaaacatattattagcaataatctgactgaagactacctttacaatttcagaataagttgggaacataattacctcagtgcacagtatttactttaactcgaacaacaaatcgctcggttggttcacctacaggaacaaactctacatgatattcgcctttgtatcgagtattcaggtcattacgaattcctgcgagtttgttgattaatgtaggactcatattaagtcccactagtttacgaagcattttgtatgcttcatcttcgatttcatgatgtttatcgtacatagttttcatttaaccattcaattgcctggtcgacgttatcaaatatgccaccgtccaaacgttcttcatgctcatagttcagcacatcaataccgaactgtccatttactaaaggccaggcaacaaacaaatattctttatgccgttcaatggcctcaatcacttcatataatcgtttcattaaaaatcaccatggttaacttgccaacattctaaaccaatacgacgccacatttccacaacctggttacggtcatcaacggccaatttcacatcataataaggagcaatacagttccaaaagagttcttccttaacaacatcatccttacgagtgtcaccttgattacgttgaatatgcatttcccatggaatagaaaacgaatccatccattttttagttgcttcgtagtaacacattgaatcttctttagttccagattcacgaccgcttacagtaataattgtatacccagcctgatgaagcatcttaacatattcgacaaccatagggttcggggcatctgtggatagtttatctaactcataaggcccacgagcaacatgtagagctaaagtcccgtcaaggtcgaagataaccgctttaggtttaccgggagttcctttataaactggaagtcctttgtattcacgcatatgagaatacatcgaacgtagaacatcgataggaacggcctttgtgccgcgcatggcattacgtttaactaattcagtccatggaacatcgaacacttgatatacaatttcatggccccactgcttagcatattcttcccagacaagacggcgttcaggatttaagttggtgtcagaaataataacacccttagttccgtcttgacagagaatcatatgtgccgcgtcgtgttgcatataagttacgatactttctttcttctttgtgtatttgtactcgtcgcgttcttcgtggcccatgatggattgacgataatcgtcgcggttgatattaaagaacccaggattcttagcaataaattcacgagcccaagtgcttttaccagacccaggacaacctacagtcaaaataatctttttcacagttttactacctcttcagcaaattcaaattgtccaccaagaattttagcaatttcacgtcctagttcagcacctttcttgcaatcttgcatagtccaggaatcgccattctgtgatttacgaagagccctggtattgatatctgctacaagcgtatggattaacttatcaattttggcttggtccattattttattcctaagaaaatttcaagaatacgaatgttatgctcgcgccggtctttattaatttcagcaacgtttttattaattgacgtacttctaacgtttgaagaaataaatttaatcatatgacttttgagttgttgcaaatccaaccctttttctttagcagctttacgaagagctttacctgcttcatctagtgcctttgctgcatctttgtcataattgccaagtgacattccacggcagatatcaatatactcatcagaccgtttgatgtaattctctagtaatgttttcatttagatttcctcaattatccataggagcattatactctgctcctgagagtttgtaaactattttactaaagattcaatatactcgtgaagagctttagtcgctactgcccacttattctgatattcatttttcagattagcacgagactgaactaacaagcggtcattagtcggaggcaaagattctaatcgttgaatctggcgcccataaatcatagccgccatttcagattcatagataagccctttaatgtattcatgctgttctttagtcattggcatttttcctcttttaaaccactacgataataacatatcatagttttctggtcatgtacatatctttttacatcgtttaaccagatacgaaattcttgagagtcttcaaatggcattccaacccatggattaccatcaataacctttacttgccatttctggttatattcaacaatagattcaggccatggcggatgtaaagtttctttagggcttaagggcacatcctgggcacatccagccaaaatgccaatagataatacaactgcggttaatttaatcattctgagagcttcctgaggtcttctgcaaaggaatcgaaggacctgttgatttgtttttcgaccaatcctggcttacttgccaccacgttcttcttcttcgaatcctgacggagcttttcattttcagccttaagttggtcaactaaaacacggttcttataagtcatttcttcgattgactgatattgaactttgaagtcgtctaatactttagcattgtttttagcagcctctttaacagaagctaattcagtattcaacgaatcaactttgttgtttaagacaactattgttacagtagaaactagagcaaaagctgctactataacataaatcggatttactttaagcatgtttgaataatctcaatgatttcgtctcgggataatccattgataagaactgttttaggcccatcagtttggattttgtaggtctcaaacattacacacaactcttctgctgtatgatatggacttgagattccgaggcggttgaatttgtcggtaagagggtcgcaaatgatgtagaattttatacctgcgatatgtacatttggttgactaatattaatgaacacattagcgtcatatttagttaaattgttttgaagaaattctaccatagcattaactgcttccggcattgcttcacgtttctcttcagcgtatcgggtggaatattccttttgctttaacttctttttagcatttttcgctagagtagtacgaaggtctgtaagataaccaactgcacggcctttcttaaagacccggattccatctgtagaatcaccaaatgctgccacaaccatatcgttagtaatcaattgcatattcataattttctcctcgtgttgttgataaacccatagtatcaccatccttggtgtttgtaaaccgttaatatccttcaggtatgaaatttttataatttttaataaagaccgattctagagcagtcataatttgctcttttgaaccaccttggtaaagattcataatgatgccaaataaccaaggcgtctgtgcacccttacaaacagcctgagcttctatggcatacgttttacgatcttttcctttgtgcttatcatatgtatctagacagatataaaatgagcggtctaagaaatcaagatatgctttttcgaagagctcgacctttttaaatgaaaactcgtcatctgcgtacatcgctttaaggtcatctgaagcaccgttcactatagcaagaaacaacttttctgggctagagattgagtctcgagtcgtatgaagagcaacataccaatcagtcttcaatttgaaatgagacccgtctttcattacggccacatacccttcaatatttgtagaagacttaacatccgatgtccagtcgccttctggtacttcaaatcggtctacaagatatttacgaaaaacaggatctagataaatgtcatcatactcaatgtattcgcctgtgttgttatcacgaatattcaaaagaatcaatcgtttttcagggtatgttaaaacaattttatttgttggagcaacgtattcgaagttagcagtgaacccgtcattacaaagttctaacaaacgatcagccaagtttttatggtcgatgtctaacaaaatactcgtagccgatacagcctggtcggatttgattgaccctttagatttgaaacgaacagtcccaccatcaagatacgtcgagactaacgaaccgtcttctttagtcatcagatattttacatcatcaaggttaattgacaatgtaaacgggttctcatttagattaaagaatttttccattggacgagaagcaatacgtataggagtttcaccatccatttcgaacataataccacgacactctaacgcgtcaggcaataaccaatctgaatatgaagcaaagttatatgagaaaattcgatactttttaccgattggacttacatcatccgagtagaaaaatttacgatcggatgacgatttacacagagataacagattataataaagcttttccattttgtatcctcagttagtttttttaaattgtaccacaatccttgtggtatgtaaactactttttcttatgttggatattccaaggcgggttgaactttttgataaaaagtggttcttcaaggtccattgttgcgatggtcattgaaccaagttcgttagtgactgaaaggtcaaaacattggcgggcccagaattcaacctttttgccttgcattaaggcatccaaaatcataagtgattttcttgaatctgaagtctggtcttttcgatttatggctgttcgataatagttaatgcgtttctttaaattcttggttttaccaatatacacaagttcgtcatctatagcaatagcatatatgacgtttttcttattagggacatcaacggttttaattgttgcatcttctaatagctccaattctatatatttaataaaggaatattcggcggcaatatctttcataataaagtgggaccgaagtcccgtccttagaaatattttttgtatgaattgattacattttggtctacatcattatcaatttgtgcgacaagataagaactgatttcaacttcctgaggagctgcttgaactaaatcagagttcagatattcacgaatccaaggatacggatgcttggtcggagcatcagtgattgggcatggcaaaccgcactgtttcatacgagacacagtcaagtaatcaacaaaagcacacatactctgcgtattgatacctggacatgtaccatctttaaagaggtgtgcagcccattccttctcttgactatttacttccataaagatatctactgcttcttgctcacactctttagcaatttgaacccattcatccccatcaacaccaagttggagctgtcgaataatgtactgagtgcctttaaggtggagttgttcgtcacgagcgatgaacttcataatctttgcattaccttccataatttccatgttcttatggaagttgaaagtacatgcaaaagatacataaaaacgaatagcttctaaggcgttaataacgtgtaagcagagataaagagacttcattaatgcacgtttacattcttccacatgcataagactatttgaatatgcatccaaatcatattcattttcggaaaaacatttaaaaatttctttagcattttcccattcacgtgttttaactagaacatcatcataatatttgccgattgattccgcacgtttcataattgcttcatctaatacaatctcatcaaataccttcgatggatcagtataaagatttcgcatgatatgagtatatgaacgagagtgaatggtttcactgaatgtccatgtagcaacccatgtatctaatgaagggtcggaaagcaatgccataagtaccgcagatggtgccctgccttggatagaatccaataatgattgatacttaaggttgttcgtaaagatgttctgttggaactgtggaagcttattgaactgcgcagagtccaacatcaagtttacctcttcagggcgccaaaaaaacgacaattgcttttcaataagctcttcaaaaactttatggcgttgaatatcgtaacgcgcaaggccaagaccagaaccaaagaacattggttcattcaaaacatcaactttttgggtattaaaaactgtactcattatattctctcaatagtgactcatccatgagtcaattataaacaaaattcttaaagcttacaagcggagcaatcttcagctttaggcgtttctaactcatagtcatctgtaccagaaccatctcgagtgttatgatagtaaaggttcttaccaccaaagtaccagaagtaaagcaagtcatcaagcattacagacattggcactttgcctttctcaaagactgaagggtcgtagtatgtattagcagaagcagattggcacacccattttaacatgataacaacttgtgtcagataaggcttattacctttcttagcgagtttccacgcatagtcataaagacccatgttgtgttcaatattaggaactacttgacggaaattaccttctttagattctttaatacttactgggccacgaggtggttcaataccatttgtgctatttgagacctggctgcttgattcgcatggcatgagagcactgagtgtactgttacgaatcccgtgttctttaagttcggctcgtagttcttcccaatcacatacatagtttggggctgcgatttggtcaatctttttattgtaccagtcgataggtaattcgcctcgagaccatttagtgtctgaataatactcgcaacgtcctttttctttggcaagtttgattgacgctttgataaggccatattgtaatctctcaaacaattcatgagtcaaatcgttagcatcttcgtatgaagcaaagttagaagccaaccaggctgcatagttagtaacaccaacacctaggtttcgacgctttttagcttttaaagcttctggaaccggatagtcttgatagtctaacaagttatcaagtgcacgtacttgcacttcagcaagttcattaattttatcttggtcttgccaatcaaatttatcaagaacaaaagcagaaagagtgcaaagtccaatttcagcatcaggactattaacatcattagttggaatagctatttcacaacatagattgctctgacgaataggagctttttcacgaataaacggggtgtagttattcgtgttatcaacaaactgtggataaattcgagcagtgccagaacgttcagtcatgaacaattcaaagagttctagtgctttgattcttttctttctgattgttgggtctttttcagctttctcataaagctcacggaatttatcttgatcttcaaagaacgagtagtatagttcgcctgacatttcgtgagggctaaataaagtaatataatcatttttaccaaggcgttccatcataaggtcattaatctgaattccgtagtccatatgtctaatacggttttcatccacgcctttgttatttttcagaaccaacaggttctctacttctaagtgccacatcggataatacgctgtagcagcaccaccacgaataccaccttgagaacaagattttactgcagtttggaaatgtttccagaatggaataacaccagtatgtcgaacttcacccataccaatcttagaaccttctgcacgaagcataccaacgttgataccgataccagctcgtttagaaatatattcaataattgatgctgaagttttgttaatagattttaacgaatcaccggcttcaataactacacaactagagaactggcgggttggagtacgagcacctgccataattggggttggcaatgaaacttgatgagtagaaacggcatcataaaaacgaataatatgtttcaaacggtcatgagtttcgtcttgatgtaaggccatgccaatagccatgatagcaaactgtggagtttcataaatcttcccagttgttttatctttaactagatatttttctttaagctgcatagcaccagcataagtcaggtcaaagtctcgttcatgtttaatctgtgaatcgagataaatgatttcttctgctgaatattgagacaacagctcagggtcatatttgccttcattaacacaataagaaatatggtcgataaaagcaggtggttcaaactgcccatacacatctttacgaagtgcaaacattaatcctttagcggcaacatattgatagtcaggttcttcgacagaaatcaagttagctgcaactttaatacaaatcttctggatatctttggtgctcatcccatcaaccagatgagtcttaatttcttcatacaattcgtatgggtcgatttgtgttccttcacactgccaagttaagacttgaataattttctgtgcatcaaaattttgggatacaccactgctcttagttacttgcatatattcctcagtataggttgatagacattactccaaacgggatagtatttatcccgttaatttattatacacttttaaactgaagcgttaattatcctcagcaataatttcttcatattctttaggagtcaagactgtaatatcgaaataaaccagaggctctttttccataccgaatccaccacagaattcacgatattcataaattcgttcatgtgaatggcaaatgaatcgttcacctttaactgtgatttcactattcggtgaagggatatccagttcacttggatttttcatttcaaaaattgtggtgccatatgaattaataaaacgtaaaatcattttataccgccattttagctttgatagctggatgtgattcgtaatttttaagaatgaaatcactcggattcatatgctctgttacccaatgaagctgtaatgtcgtgctccaatcagagaatccttcaggccaatcaattttaagttcacacagttctttaggctcacgacgaagaacttctttgcattgttctacatgattgctgtagatatgcgtgttgccgcctgagaacactaaatcacctgggataagattacacatcttcgctacgatatgagtcaaggcagcgtatgaggcaatattaaacggtagtcctaagaatacatctactgaacgttgataccattgcaggtcaagatgaccattacgtacgttgaactgataaaacatatgacatggaggaagagccatttggtcgatttcagccgggttccatgcagaaacaatttgacgtctgtcattaggaagagctttaatacgatcgatagttttaaccaattggtccacaccaccgaaatcacgccattgtttaccatatataggaccaagttcaccactatgataaccaaggtcttttgcctgattttcgtaattatcgtcccaaatagttttaccttcaataaggctaccatgagtacgaagacgtaaatcattaacgttggtagaaccagatataaaccaaagtaattcagcgatacaagctttccatgccagtttcttagttgttactgcaggaaatcctttagtcaggtcccaacgcaatttagtcccgaaaagagcaatagtgcctgtacctgtacggtcgtctgtttcatagccattttctaggatatcattaatcaggtattggtattgtttcatttatacacactctcagtaatttcggtgagttcatcgattctgtagtaatgagattctaccatagaacgttgaagcataatatcttggacgaaatctttatcaagttgaacatcggaattaacacgacatttcttaatgattttagtcatcacgatttcatcggcataaggcagtgcttgttttaataaagcaggaccgccaataaccgagacatcaacatgttcagtagaaagtttaaacggtacgtcagttgcagggctaaacaggttaatttcgccaccggttaccaaggtaataaattcagattgggtgatatagaaccgtgcaagttcgtcgcttttagtcctaggcagttttctagacatatcggtgacaactacatgagtacgatctgggagtagacgaggtaatgatgcaaaagtcttagcacccataaccattacagtgtttttagtgcgagcaacaaagttactcatatcttgtttgatatgcttccatggaagtccatcacctaatccaaaagcatattccagtttatcatcaactgttttagatggtgcgcatgcgaatactaatttaagcatttttatttcctcagatttttcttaacaactttccaatcagctttaaacgattcaacatcagagtggcaaatccagaatcctgcgctttcgccgtcttcataaagtggacatccatcacattcttcattccagcccatttcacgtaaagctgcttcagcttgttcaaggagttcagcatctttatcaaggatgttgaagtaccatttgcctttaacttcagaatcgttaatgctttggcgttgtaatttcattttattctccgttgcttcatttgttttgacagggtaatagtatcacaccattaccctgttgtatactattttattccaaaaatttctttaatttctgcaatcacatctcgagcattttccgtagtcacttcaaagatgagtgattgtttagaaatagactctggagatacctcgatgaagtgtttaaactcatcatcataaagctcaaaatatgaacctggcttaccatcaaaaccgaattcagtaccgtctcgcatagttacacgggttacacatttatcatcatcataatctgtgttcatgtcttttacaacaaaactaggaccatgaagctcaatcaaagccagcatatcggcgttttgtgggcattcattggcgaagatagctttacattctggattgatgatataagtttttccaattttcattttgatttcctctcatttgttttgataggattactataacatagtcctatctttttgtatactactttttaaaagttttttgcaaaagtttgatgatttcgtcgacgttggtttcatctacgatacaatggatttttgttacacctaaagttataccttcgttagtagattgaggcttttctaaagttacctcagtaaagtatttgaattcttcagagtaaatctcaaaatacgtctcaagtgggccaccagccatgtattcagtgccgtcttccatagttacacgtaccacacagtcaccagcacaatcatcactttccatttcatctacaacaaaactaggtccgtgcttctctattaaatttagcatcattacattgcaacggcactcgttagcaaagtcatctttaaataaagggttaatgatataagattttccgatttccattttgatttcctcatgttgttgataggtctatactaacacattcagggaagaagtaaacaactttttcagcaatttacagatactcaaaagggagaccgaagtctcccgatttattatagaccagctaacaggtcatcgaggtcgccatcatcagaggatgaggtagagctcatgaagtcatcttcagtttttgcagaactaaaggcttccatgtctttatcaaaatcgtcaaggtcagaagcaactttatctgcaacagaagctgctgcggctgctgcaccaccaagagcggcagtaccaagaaccttagcgaaagattcatttaatttttcaaaggacttgaactggtctttagccgtcaaagtagtaaggtctaccatctggtcatatagttctttctggaatgcttcgtcattaatacgaggaatttcagattgacccaagaatttagattcgtcgtagttgctaaaaccagaaacctgcttagctttcagaacgaagttggcaccttcaaacggacaagtaacatcaaccggagtttcacccatttcggtatcaactgcaatcattgcattgattttgtcccaaatctttttaccgaaacgatatttaaatactttaccttcgttatctggagcttgagggtctttaacaaccagaatattagcccaataagaagttttacgtttcagttgagaatattcagttttgttggtattgtacaggtcatttttactaatgtactgacatacaggacaagagtcgtaatcaccatgtgtagaagagcaattttcaatataccatttaccatttttcttgaaaccgtggttaacaagaattgcaaatggtagtgcgtcatcagtttttgctggcaggaaacgaattaccgcttgaccattacctgatgcatctagcttcagcttccattcgcctttatcttctgaagagaaacctttgttaccgttcagtttagccatttgagcagcgaggtcagcagtagatttacgtttaaacattatatttacctttatttagattatttaatttatttacagttggttgctacgacacttatacctcgtagctggtatgatttatttataaagtaattttaacacacaagaaataaagcttaatacttacatgatttgattgtttctatgaacaatttcttagcagcatttccatcgatttgaagtatttttcgatatgcctttaatttggtagaataattttgccagactaaattgtcagtaagttcgtcatgcttatctataatattcaagaatgaatccaacaacaagaaggtttcaaatgaaattatattgctttgtagcaatttgaatatgtagctcgactgaacgttgttattataatcaaatatctcttgaagcgcactaacttcaactttcttactgaaatagtagatgttacgtacgtcttcggcaaatgtctctttagcttgtttgagacgtccaatatattccctatagaaaactaatgcatcagcgtctgatatctcaccaatccatgcgtcttggttagcaactaagttgcttatgaatatcaaggtgagttccttcaatttatatttctctgctagtttttcaaagaaatatttatctcggcgtttttgatacgcattatccgaaacacgcatgcaccagttatatttgattacgtcataccgaccaccaaaatggtttttgcacatcaagtatagtttatataccgattttccattaatataacgttctccatcaggaggcatgcgtattttaatcatatttccatccggaccattttgaagatttaagtctatatgtaactaaagacgcagaaatattaaaaacatttgaaacttctttacacgaggcgtattttataccatcaataattataggtttttgttttttaatagttctttctttagaatgcgactttgaatttgctattctaagagcttctttggttgaatcaggcatcggcttattcgtttttcgcccttttcggactttactcaaggccaatttgtgagcttcagatagtttcttacccttattaggtgacggtatttttctttctagtcttgttttagatactttagccttagtctcttcagatctaggtttacctaatttagaaagtgaaatagaccttttagcttcatcactttgttttttaccaggaccacctttaccaccgggaactaagttataagtatcatctcgcaaaacaaaatcttcgttaaccaattctgcttcttttttataggcgtccttgtcattatcatattcataaagaatttcggtataaaaattttttagtccatatttagctttggccgctaatatagcgcggcctgatccaatataccaatctttctctttatgttttttgtgtacgcctatataaattttaccatttattttattggtagttttatacacaacgtatttcataataagaaatctaacgtattagttttttcaccacgagcaactgatgggcgaagcatgttttcgtcaattgcttcgcttgtaattttttcaacaattcctgtaggaataaatttagcaaattgtgtttctggaatagaattttcttctaagaaagcagttgttgcttctaaataagacataccaaattgttcaaccatagattcgataatgaatccgttttcttgacggtcaagcaatttagcgatatcatctttatcgtgttttactgctaattcttgttcagataaaccggcctcatcaaccggtttaatatcacttagtgaaaactgtgtcataaagctcgactacctcttcgttttcagcttcaaattggtcacgagcatctttatgataaagagctaacaaacgattaaacatttttccatcgacaccaagctcttctttagcacgagtacgaatgtctttaatcagttcattataaccagaaattttaagtttgttatcggaagcttccttgactagtttagccagttcttcaccatgcacatcttgattaaattcaactgcttctttcttagtcatgtttacctcagaattcattaattacacttgttaatttagaaagtccagattttacaaagtatgaataaatcttgcctttaggttgttgtttatatgagttataatactctataatggttgaagcaatattatcagggatataatcaaaatcaatgagaaccaaattttcttgataccgtttatattcttctgcacttaataatacttcagcttgagaacggtcattagcaattgcttcaataattgatgttttcatgcttggagttcgttcaccttcaactctggtaaaccagaagtcaccacgaactcgaacagatgcaacaccatccttacggtcgcctttaagaattttagtcatgcaatcaatttcagcagaaccgttcttaattttaacccattttttctgtggtggcgaccactgtttaacgttaggatatttgtgtaattgtgtaaagtcaccatctgatgcaacaatacataccttatgaccggctaatgacaaatatttagttaatacaccgatatggtcatccgcttcatacttgtcaatatccattacaacgtatggcatgtatttcttaatctcatcaacaacttgatggagtgcagtaaaatatccttcccaatcccactttgaagcttcacgatcggttttgcgatttttcttgtaatagtaagcaaagtcacgtcgccaataacctgaagtagcattatccatacacaatacaaattttgtatagccttgcttacggaacatcactacgtttttacgaattgaattcaagattacatggcgaaccatcggaacagtaattttatcaccatcttcaaagttgtttaatgcggctgccaacgcaatgttactaaagtcggcaagtgcaataccttctttgtaatcttcatccaacatcatttctaaatccatatgaacctcttgttcagttagtcaacttgtctatagtaacacactcatttgaaagcgtaaactggtataaataagtattattgaaacaataaaggaaaaacgaatggccgacatcaaacgtaagttcagagccgaagacggtctggacgccggtggcgacaagattgttaacgtagcattagccgaccgtacagtaggtactgatggcgtaaacgttgacttcctggtacaagaaaacaccgttcaagtatatgattctacgcgtggatacaacaaaggatttgttgttctttatgacaaccgtttatatcaagcaataaatgatatcgtgtctccttccggggcatttaaccttttacaatggcgtgcagttcgtactgatgcacaatggataactgtcgcttctgggacttatcaactttcttcaggtgaatcgatttcggttaacactggggccggcaatgatatggtttttacattgccaaatactccagttgatggtgatactgttgttttggctgatattggtggacgaaccgggacagttaaagtacagattaacgcgtctgtacagagtattttaaactttagaggtgaacaagttcgtacggttttaatgacgcgcccacgttcacaactattgtttgtgtttagtaatcgtttgtggcagatgtatattaccgattatggtaaagaatcaatcactgttacacctgcgacaccatatcaagcacaagcaaatgattttatcgttcgtcgttttactagtgcagcaccaatcaacattacacttccacgtaatgctaacaatggtgatataatcagcctagtcgatttagatagattaaacccactgtatcatacaattgttaaaacatttgatgatacaacgtctattggtgaagtcgggacccatattgctgaaggcagaaatgactctgacgcgttttttgtttttgatgctgcaaatagtttatggcgtatatgggaaggcgaccagaaatcgcgtcttcgtattatccgtgcggattcaaatattcgtccaaatgaagaagttcttatctttggcacaaataacgctacaaccggaactattaatcttacgctgcctaccggaattttgagtggtgacactgttaaaatttcaatgaactacatgcgtaaaggtcaaacagtaaaaattaaagctgccgaaggtgatacaattgcttccactgttgcattgcttcagttccctaaacgttctgaatatccacctgatgctcaatgggtctctgttactgaactagaattcaatggcactacttcatatgttcctgtattagaattagcgtatatcgaagacaccgttgctggtacacgttattgggttgttcaacaaaacgtcccaaccgtagaacgtgtcgatgctggaactgatgctacacgagctcgtttaggtgttattgctcttgctactcaagcgcaagcaaatgttgatttagagaatactccagctaaagaagtggctattactcctgaaacgttggcaaatcgtacagcaactgaagctcgacgtggtatcgctaaaattgctacaacagcacaagttaaccagaattccacagcagcatttgtggacgatactattgttacgcctaaaaaattaaatgagcgtacagcaactgaaactcgtcgtggtcttgctgaaattgctactcaggttgaaaccgatgctggtcttgatgacacaacgattattacacctaagaaattacaggcacgtcagggttctgaaacactgtctggtatagttaaatatgtatcaactacttctgctactcctgctgaaactcgtggggctgcaggcactaacgtttataataaaaccgtaaataatttaactatttctcctaaagcccttgaccaatataaagcaacttatgctcaacaaggtgcagtaattttagctgttgatagtgaagtaattgctggtcaatcacaagcaggttattctcacgctgtagtaactcctgaaacactacataagaaaacttctactgatggacgtattggtttaattgaaattgctacgcaagcagaaactaatgctgggactgattatacacgtgcagtaacgcctaagacgttaaatgataggaaagctacggaaggattatccggcatagccgaacttgctacgcaagttgaatttgatactggaactgatgatactcgtatctcgactccactgaaaattaaaactcattttgattcttctgaccgtaccagtgttaattctgattccggacttattgaagaaggaaccttgtggaaccattatactcttgatatttctaaagcaaatgaaacacaacgtggtacacttcgcgtagcgacccaggcagaatctaatgcaggaactttagatgatgttcttattactcctaaaaagcttttagggactaagtccactgaaacgtctgaaggcgtaattaaggttgctactcaggctgaaactgtaacaggaacttctgctaatactgctgtatctcctaagaatttaaaatggattgtccagaatgaaccaacatgggctgctactacagcaattcgcggattcgttaaaacttcatctggttctattacatttgttggtaatgatacagttggttcaacacaacctttagaatcgtatgaaaaaaatagctatgctatatctccatatgaattaaaccgtgtacttgctaactatttgccattgaaagctaaagctgctgatgcaaatttattagatggcctagattcatctcagttcattcgtagggacattgcgcagacggttaatggttcactaaccttaacccaacaaacgaatctgagtgcccctcttgtatcatctagtactgctacgtttggtggttcagtttcggcaaatagtacattaactatttctaatactggaacagctactcgactgatttttgaaaaaggacctcaaactggaactaacccagcacagacgatgactatcagagtttggggaaatgaatttggtgatggttcagatacaacacgttctactgtatttgaagttggtgatgaaacgtctaatcatttttattctcaacgtaataaagatgggaatatagcgtttagcattaatggtactgtaatgccaataaacattaatgcttccggtttgatgaatgttaatggcgttgcaacatttggtcgttcagtcacagccaatggtgaattcattagcaagtctgcaaatgctttcagagcaattagcggtgattacggattctttattcgtaatgatgctgctaatacctattttatgcttactgcatccggtgatcagaccggtggatttaatggattacgtcctttggctattaataatgcatctggccaagtaacgattggtgaaggcttaatcattgccaaaggtgctactataaattcaggtggtttaactgttaactcgagaattcgttctcagggtactaaagcatctgatttatatacccgcgcgccaacatctgataccgtaggattctggtcaatcgatattaacgattcagccacttataaccagttcccgggttattttaaaatggttgaaaaaactaatgaagtgactgggcttccatacttagaacgtggcgaagaagttaaatctcctggtacattgactcagtttggtaatacacttgattcgctttaccaagattggattacttatccaacaactccagaggcacgtacaacccgttggacacgtacatggcagaaaactaaaaattcttggtcaagttttgttcaggtatttgatggtggaaaccctcctcaaccttctgatattggtgctttaccttctgataatgcaacaatcggaaacttgacaataagggatttcttaaggattggtaatgtccgcattattccagaccctgtgaataaatctgttaaatttgagtggattgaataagaggtattatggaaaaatttatggctaagtttggacaaggatacgtccaaacgccatttttatcggaaagcaattcagtacgatttaaattaagcatagcgggctcttgtccgctatcaacatctcctgcttatattaagttccaggataatccacttgggtcccaggttttttccgttggattaaacgttcgtgtaataaatcctacaacaggtgcagtagttgaatctaagtcatataatttctctactgaaaacgacgcaacgtcaagtgcatttgttactttcatggacacatatgcttcaaattttatatttgctcttgttactaacgctaaaacaaactttccaccagaagttcttgcatggtttactaaagctgggagttctgctattccattagctcaacaagttttaaatatagtggacatttcttattctgcattttatatttctggtaagaatgctatagcgctagaacatattaagtatagtaataagaaaacttcaaccgactatagtacaccacttgatgttgtgtacgacacgatcgatgatattggtgctacaggcttccctagacgtacgtacgaatcgacagacacatttttatctgctgttggaggtactaataatgaaattaaaaggatgcctacaacatccattattacgcctctcgctgggtataaattgaagcctggagatttcctttatatgaaattccaactaatggccgatgctgatttgttagcacaagggacgacacgactttctattcgtttctttaaatctccttctacttcacctatttcatttaaagatataaactttgatgggagcgcaggtgaatggaagatatatgaagactacatagaaattcctgctggtgctgacgggttcacgatttattgttatcgtacagctccagtcggccaaggtggattaagaaacgttatattcactgaagtatcatgtaatggaagcgtttcaaaaccggccgagtttggtataaatggtattcgtgtaaattatgtttcagaatctttaagtgccccagacataatgacactacctactcaatcttcaactgatactggtaaggtatttggacaagaatttaaagaagcatcagaataaatttagggagacttcggtctcccatttttgtataaatatggtatacatataaggagacaactatggccgatttaaaagctggtagtacaactggcggtgctgttatatggcatcaaggtaatttccctttaatgccagcaggtgatgacgtcctgtataaaacgtttaaactctattcagaatataataaaccacaagcggctgataacgatttcgtttctaaagctaatggtggtacgtatgcatcaaaggtaacatttaacggcggcgttcaagtcccgtatgctgtaaacaacacaaacccgtgcggtatttatccaggtaacggtgataatgctacttttgctgtagcaaatatcgatattgtttcatggaatggtattggttttaaatcatcgcaaggttcagcagcccgaactgttgtaattaatgcacgtaatggtgatattaatacaaaaggtgttgtgtctgcggcaggtcaagtaagaagtgatgcagctgctcctatagcagcgaatgaccttactagaaaggactatgttgatggacgaataaatattgttacggataacgcaaattcccgtgtattgcgtaaaggcgataccatgactggtactttaacagcaccaaactttttctcacagaatccggcgtctgaggctaatcatgttcctcgtttcgaccagattgtaattaaagattctgttcaagatttcggctattattaagaggacttatggctacattaaaacagatacaatttaaaagaagcaaagtggcaggagttaatcctactgcagcacaattagccgaaggcgaattagcgataaacttaaaagaccgaactctttttactaaagatgacctcggtaatattattagcctgggctttgctaagggtgggcaagttgacggcaacgttactattaacggtcttttgagattaaatggcgattatgtacaaacaggtggaatgactgtaaacggaccaattggttctactgatggcgtaactgcaaaagttttcagatctacacagggttcgttttatacaagagcaacaaacgatactgcaaatgcccatttatggtttgaaaatgccgatggcactgaacgaggcgttatatatgctcgtcctcaaactacaactgatggtgaaatacgccttagggttagacaaagaacaggaagcactactaatagtgaattctatttccgttctataaatggaggcgaatttcaggctaaccgtattttagcatcagattcgttagtaactaaacgcattgcagttgatacagttattcacggtggcaaagcctttggtgtatatgatacggattcattagttaactatgtatacccaggcaccggtgaaacgaatggtgtaaactatcttcgtagagttcgtgccaaatccggtggcactatgtggcatgagctttgtactgctcaattaggccaagctgatgaaatgtcttggtggacaggtaatactccacagtcaaaacagtatggtattcgtaatgatggtcgaatggctggccgtaatagccttgcattaggtacattcactacagatttcccgtctagcgattatggtaacgtcggtgtaatgggcgataagtatcttgttctcggtgacactgtaacaggtctgaaatatattaaacaaggagtttatgatttagttggcggtggttattctgttgcttctattactcctgacagtttccgtagtactcgtaaagcgttatttggacgttcagaagaccaaggcactacatggattatgcctggtactaatgctgcatttttatcagtccaaactcaagcggatgtgaataacgcaggggacggtcagacgcatattggctataactctggtggaaaaatgtcgcactatttccgcggtaaaggccaaatgaatattaatacccaagaaggtatggaaattaaccccggtgttcttaaactagtaacaggcgctaataatgtaaggttttatgctgatggcggtattacatctgttaagcagctttcaatatataacggcgtatatttagcagctaataactcaacagcaggtttgactttttcagcaactaccacgattgatggcaccaaacaaatcctttgggaaggcggcactcgagcaggccagaataagagttatgtaactgttaaagcatggggtaatgcctttaacgcatctggcgatcattcccgtgaaacagtttttgaagtatcagatggacaaggttaccatttttattctcaacgagttgctcctggtgcaggttctactgtcggacctattcaattccgagttaatggcggtttattaacttcaggtagtattgttgcttctggttctattacaactgaatcttctttgagtgttaataatggcatgacagtaaatggccaggctaagtttggcggaactgcagatgcgttaagaatttggaatgctgaatatggtgctattttccgtcgttcagaggcggcattgcatattatcccgactcctaaagatgctggagaatcaggtggaataagcaatctccgtccattaagtattagtcttaataatggtatggtacaaatgcgccattctgtcacgttaggcgatgatggcgctggcggtaatatgattactgtggacaatgataacaaacttgttgttgttactagtcatagtcgtatttctcctaattaccgtatgcaggtaggacaagcagcttatattgatgctgaatgtactgacaccgttcgcccggctggtgcagggtcttttgcttcacaaaataatgaaaacgttcgtgctccgttctatatgaatattaatcgcacagatacaagtacttacgttcctattttaaaacaacgttatgttcaaggaaatagctgttattctttaggtactttaataaatggcggtaacttcagagttcattatcatgaaggtggagacggaagttcaacaggcgcaactataaaagatttaggctgggaatttacacgttctggtgattttatatctcctaagcgcatttctgctgggggttcagtttatttaggtacagacggtaacattactggtggttctggtaattttgctaacttgaataccacaataaataaccttaagatagatattgtgtcgagttatccaattggtgctccgattccttggcctactgatacacctcctgaaggttatgccatcatggaaggtcaaacatttgatgtcgacttatatcctaagttagctgcagtgtatccttccggctctctgcctgatatgcgcggtcagacgattaaaggtaaaccatccggacgtgcagtattaagtacagaagcagatggtgttaagtcacatagccatagtgcaagtgcatcaagcacagatttgggtactaagaccacttctagttttgattacggaagcaaaacgacttcaagctttgattatggtactaagaccagtaataccactggtaaccataaccatacagtgagtggtaatactagttccgctggtgcgcaccaacacgcgcgttcaggtcctcaggtacaaggcggcatacccactagcgtattctatgatggatacaatagtgcgggtccaaacggcaacgctaaattcactgcaaccgtgagcggtgctactgcatcgtcgaatatggccaaaacttcttcagacggtgcccacacccatagttggtcaggaactactagcgctacgggtaaccatgctcatactgtgggtattggtgctcatacccattcggtaggtattggtgctcattctcatactgttgcaattggttcccatggtcatacaataactgtaaatgccacaggaaatacagaaaacacagttaaaaacgttgcttttaactatatcgttcgtttagcataaggagaagggacttcggtccctttttataatatgaaactctatcactattattttgacactaaagaattttacaaagaagaaaattataaaccattaaaaggcgtaggatttccggctcattcgacaccaaaaaaacctttagaccctaaagaaggctatgctgttatatttgacgaacgcgagcaagaatgggtatatgttgaagaccatcgcggaaaaacagtatggacatatgataagcaaaaaattgttattgacactccaggtgctcttcaaaatgttactacagaagaacctggtgaatttgacatttggacag

SEQ ID NO: 5 - DNA, 168195 bp, Escherichia phage
  source 1..168195: mol_type = genomic DNA; note = HP3.1
ccgccgccgccgccaccgccgcctgcaatagctccgccattattaattcttagtctcccaccaatatcgttttgaatacaatgacctccagctgaaccaggactattgctaccgccattaccgccacgtccatacatcgttacgccgtgtatattcaactgaacatattcattcggtgtatctccgtacatgaagaataaaggaacatctttagaatatgatactaaatcacctgtaatattaaacactataggtgcactacctgcctcaaaacatctatctcggaaccattgaccattgaagttatggtctgctccaagcgtgtgaataatttctcgtgagcgacctgcaaattgactcatccagcaaggaacacccaatcttaattgaccagccgcttgactcatccagcgctgtcctgtttcatttgcggctgaacttccaatccaaccaggaacaccaactactgccataatttatactccaaagggggcatttcccccttgttgttagaatttaaaatatttactaattttgcgagcaattttagtaaagaaaggagttttcaattctttaatttcttcactcatttcctgaatagccttaattaaaagagcattcacagcagagttagaaattgtcagaacatcagatccatcaacttcaactttagatacagcttccggtaattccttttcaaggtcctgagcaataataccaacttcacgtttaataacactacggtctttaatagacttaactttatcgtaaatataaactttcagtcgacatactttttcaagtgctccgttttctagctcttttttattaatcttaagacgaccatcggaacgaatatacacatcgttaaagttaccattaccaggagaatagaaagtaccgtcgtaatgaaattcaaataccgcgttagggtgtccagccgctggcgatgcctccgcagatccaacacgaataattgcttgcccccaattgttagggacacgacgaataccaagatcgacggcagttacaaacccttgattggtgattacacttcttcctttgagaatcggataataacaatcctgtgaaacataaccatgatcgacgaatattggtgcttctactcgccattggttgccccaatcacccggttgtctagcaatccatccagaaccgttaatgtgtacacgatcgcggttaacgttaaccattgcgatattttgtggatttagcgaaatctcaccattgtttgtgatatgtactgccgcctgagtagcatagctataaaatgctagcgaattatcagcaccacccttaccaatataccagttaccactcccgtctacgtcaccacgaatatgcaaagcattaccagcagttgttgataatacaatagaatcacccggacgtttaataatcaatctaccttcggattcaatttcaccaaaaaatttagtcttaattgcaccagtcgctaaagtacgttcagtggaaaaatgaacgcctttgctgtcttctaactgaataatgttatcgcgcgcattattactatcaccccaatgattaaaccggaaataatcacgtgattgcttaccacccgcttcaaacgtcagcgtacctttacttaaattaacatcaccgctaaaggtagcagcaagagaatcacgttctaattttaaaacgttagcaccactagtaccacctaaagtaacatcaccagttctcaattcataacggaaaggtctatttgtattatagtttccattttgatcatcttcgttggtggaaagaatataaagattctctccataagtacggaaaattgtaccaaaatttccggcatacatacggaatgcattagatgagcgaaatttaacttctgttttaaaagtggtagtgttattaaggttaacagtagagttaaaattggtaggagcaccgaagttaactgcgccattaaaatcttgttgagctgtccatgtgtggcgaccatcttcaagaacaacacggcggactgtgcaagttctatttccagaattaccgaacacacgaacgacaaaataacggtagtttgtctgggatacagtaccgcgccaaacctgaacagtacgccctgtgctagtgtgttcgctaggaccaacggaaaacataaccaggtttccgtcaatcgtcccccaatccatatttgctggcatattctttattttgttcaaaggaacactaaacatactaccagggacaaaatcaaaggtttgccaatctagctccgctaattgagttttaataccacccatacccaaagtaattggcaaagagtaagatgtatatacttcgttccatgtaccccacgcgccaccggtatatgcacgctcaaaaatacgatcgcgagtagttgcacccgttccggcagtagtaaatttttggaaaatagcaccaccagaagcacgctgtttaacttccagcaaaccaacaataacggctggtaaaccttcaccagtaggacagttaataacggcatcagtgcctaaaatgttatataacccaggagttttaaaatcattcagatctccatcatagaaagtcgctggtgtgccatgaccaacctgcttccattcctcccacttaggtgcactagcatcccatgcagcagcgagacaacgagtataaaccatacccatgcgggtagtataacgctgagttctcgtgtataaaccaccttcaaatatttctaaaaatccttgtgcggctgatccttcttctggataatggcgatcaaatgatgcgattgcgcttgaactgtttcgccataagccacaatgttctaattctcccaagctatcaaggtcaatcgtttgtgaaagtggacgagttgacgcttgaacattacgccacacaccccatggaccattgacgccattccatttagcagataaggaacgaatatagacgttaccagatcttacagtataacgctgagtgccagcaaattggccggccacaaacacttctagtacacctacggcattttcttctgggaatttatttgctggttgcgcatttgttgaagtagatttcgaccaaacaccaagatattcttcaatgggcccatacgtatctaaattagcatcagtaggtaattcgccattattttttataaatgttgtgctattgacatttatgtcagatggagttaaggtaatgtcctttgacccatcaaaagatataccattaattttcctaggtgtttgcaatttagtagctgtgctagaatttccaattaaagttccagttatattttctgtaacctctaaagacccatttatagttcctccatattttaaacctaattctataacactacctgagtcatcttttgtgaaaattgttttatcttttaagtttatagccaattcaccttcggctaatactgaagcagcaggacgttgacctgcagttttgcttcttttaaattgtatttgttttaaagtagccataagtcctcttaataatagccgaaatcttgaacagaatccttaattacgatttggtcaaatcgtggaacgtgtgaaggttgagatgcaggattctgtgaaaaaaggtttggcgcagttaaatttcctgtcatagtgtctccagagcgtaataccctagagtttgcatttgctgtaacagtatttattgctccatcaacataatctttgcgagtaacatcagatgctgcggaaggagtagatgtaacagttaccgatggagccgttacagccctggtaaatgttgtcaaaccttctggcgtaatagtaatttgtccagtagtgatttcactacctgctggtctaaaactaataccgccagaagagccaccaactacaagagtattaccagtgccgccaccagaacgaattcggatgggggtttcattattacttaattgaagataactatttaccccgtaattaatagtaattggaccggtgtaagtaccaccattagctttagaaacgaaatcgttatcagctgcctgcggtttattatattctgaatatattttaaatgatttgtagagtacatcgtcaccggctgaattcaatggaaaatttccttgatgccaaatgacagatccacctacagttgaacctacttttaaatcagccattatatgcccctttattttaatattatttataaagaaaaagggaacccgaaggctccctcagtttaaacttctctaaattcttgcccaaacactttgccagttttagaagaggcttgtgtaggaagtaccattatatctggaggtgaagccgattcgcagacataattaacgcgaataccgttgacgccaaattcggcaggttttgaaatgccgccatttcttgatacttcagaaaagcttaaatttctcatgccgccttgacctgcttgggcagttctttgtgcatatatcgtaaatcctactgcattttcaggaacaactacataatcttcttttaattcccaagacccagcttgcccagtaaactcagcttgggtcgaggaaatatatccatttgatgcatcataaaaacgaatagatatatttgtagttccaagatcaagtaaatcagcatcagcatatagttgtgctttaagataaagaacatcaccaggaattaaattgtagtcagaaagtttacttatagcagctgaagttggcaatcgcgcaatttcattattagttcctccaaccgcagacataaattgctcaacgctttcgtatgttcttttaggaaatcctgtagctccgacgtcttctaaactatcaaatacaacatctaaaatagtttgataatcatctgtgctttttctattacttagtttaacatgctctaatgcaatagctcttttagaagaagtataaaaagcagcatatgatacgtcaaatcttgacaatactgaatctgatggaaaaactgaagttcctgctccccttaaccaagataccacttcaggaggaaaattaacctttccgctagttaatatagcagcaagtctattgtttgacaaagaattcatgaaactgacaaaagcagctgatgtagtattatttgaagcagaaaaagcatatgacttgctatcaactaatgctcccgtagaagggtcaaaaactcttaaatgaagacctgcactaaatgtttgatttccaacgggattatcctgaaatttaacatatggccccgcagtagaaagcgggcaagaacccgctatgcttattttatatcttactgaattgctttccgataaaaatggcgtttggacatatccttgtccaaactctgccataaatttttccataatacctcttattcaacccattcaaatttaacagttttattcactgggtcaggaataatgcgaacattaccaattcgtaagaaatcacgaatagtaagattacctattattccattatcagatgggatcgctcctatatctgaaggttgaggagggttacctccgtcaaatacctgaacaaaacttgaccaagagtttttggttttctgccatgtacgtgtccagcgagtggtacgtgcttctggggtcgttggataagtaatccaatcttggtaaagcgaatcaagtgtgttaccaaactgagtcaatgtaccaggagatttaacttcttcgccacgttctaagtatggaagcccagtcacttcattagttttttcaaccattttaaaataacccgggaactggttataagtggctgaatcattaatatcgattgaccagaatcctacagtatcagatgtcggcgcgcgggtatataaatcagaggttttagtaccctgagaacgaattctcgagttaacagtcaaaccacccgaacttatagtagcaccttttgcaatgattaagctttcaccaatcgttacttggccagatgcattattaatagctaaaggacgcaatccattaaatacgccagtttgatcacccgatgcagtaagcataaaattcgttactgatccatcattgcgaacaatgaaaccataatttccgttaatagcacggaaagcatttgcgcttcgagaaataatttcaccagttgcagtgactgaattaccaaatgttgctacaccatttgcattcaatgttcctgaagcattaacatttatcggtgttactgtaccgttgatattaaatgttatatttccagctttattacgctgagaataaaaatgactagacgtttcatcactaacttcaaatacggtagaacgtgttgtgtctgattccccactaaattgatttccccacactctgactgtcatcgtttgagccgggtttgttccagtttgaggtcctttctcaaaaatcagacgagttgccgttccagtattagaaatagttaatgtactatttgctgaaactgatccaccgaatgtagcagtactagatgatacaagaggggcactcagattcgtttgttgggttaaggttagtgaaccattaactgtttgtgcaatgtccctacgaatgaactggagcgaatctagaccatctaataaattactatctacggcttttgcttttaatggcaaataatttgctaatacgcgatttaattcatatggtgatactgcataaccatttttctcatatgattctaatggctgtgttgaaccagctgtatcattaccaacgaatgtaattgaaccagacgaagttttaacaaaacctcttatcgcagtagtcgctgcccaagtaggttcactctgcacaatccattttaaattttttggagatacagcagtatttgctgacgttccagctacagtttcagaccgagttgcaactttaataacgccttcctgtgcttcagtagatttagtacctaaaagctttttaggagttattaaaacattatctaatgttcctgcagcagcttcaacttgtgtagctacacgaagtgtaccacgctgtgtctcatttgcttcaagaatattaagggtataatggtcccagagagttcctgattcaactaatccagatagagcaacaacagaagtacgatcagtactattaaatctggttttaatttttaatggtgtagagatacgagtatcgtcgacgcctgcgtcgaattcaacctgtgtagcaatttcagctataccacttaaactttcagttgctctacggtcatttaaagttttaggagtgactgcacgagtataatcagttcctgtattaacttcactttgcgtagcaatttcaattaaaccaattcttccatcagttgatgtctttttatgtaacgtttctggtgttacaaccgcatttgcccatccttcttggctttgtccagcaattacttcactttcaactgctaaaattactgcgccttgttgcgttggagtagctttatactgatccaaagctttaggtgaaacaactaaattattagtgtttttattataaacattcgtaccatttaattcacgactagaagctggagtagctcctgcagtagatacaaaagttacaatacccgataatgtttcagaaccttgacgagcttgaagctttttaggagtgatgattgtagtatcatcgatacctgtattagtttcctgctgcgtagcaatttcagcaacacctctgcgagtttctgtagcagttctttcattcagctttttaggagtgatgataaggtcatctgcaaaagagaatgtagtgttctgatttacttgagcagtagttgctattcttgcaatacctctgcgagtttcagtagcagtacgattagctaacgtttctggagtaattgctaattctttttgtggagaattttctaaatcagcatttgcttgagcttgcgtagctaaagcaattacgcctaatcttgctctagtagaagcatttaaagagtctactctttctacagttggaacgttttgctgtacaacccagtattttccatcagaatcttctatataagcaagttgcaaaactggtacataattagtttcaccattaaaaactaattcttgaactgttacccattcagcttcaggcggatattctgaacgttttgggaattgcagcaattgaactgaagaagcaattttatcttcaccagcagctttgattttaactgtttgtccttttctcatgtaattcatggaaattttaacagtatcaccaacagaaatatcagtcggaagctgaagttcaattgtttgggttgttccattattcgcgccaaataccatgacttcttcatttggacgaatatttgaattagttgttataatgcgtaaacgtgctttactatccccgtcaaacaatctccacaatttctcattatcgtcaaacatcaagaaaccgtcaatcgatgtacggccttcaatggaatgagttccaacttcttgtactgaagtcgtttcatcgtatgtagtaacaattgtatgataaagtggattcagtttatctaaatcaacgaaattaataatatcgccatgattagcaaatctcggaagtttaacattaattggtgcagcagaagtaaatctacgtacgataaaatcattagattgtgcttgatacgcagtcgatggagtaacaatcgcagcttctctgctataatcagcaacatacatttgccacaaacgattattaaaaatgaatatcatctgtgactttggatgagtcattaaaactgaacgtacctgttcacctctaaaattgacaatactctgatttgaagaatttattttaacctgatttatgccaggttttccaccgatatcttgaattattacggtttctccatcaagcggagaaggtggtaaagtaaactcaatgtcattgccaactgatgtatctactgaaattgcttctccggattttaattgatatggtccagatgatacggttgtatatacggcatcagtacgtaatgctttccaacgaattctattaaaatttccagcaggttttggaatattatccgttgctgcccaaaaacgattattataaatgattacaaaatcttttaaatatccacgagttgggtcatattgctgaactgtgttttcttgaattaagtaatcaacgttaacaccgtcagttcctacggtacgatcagctaaagctacgttgattattttatcgccacctgcgtccagaccatcttctgctctgaactttcttttaatctcggccattctcccgggctcctattgtgttttcaataataagtatttatacctgtttactttaagatttagatagtatataatagaaatctcactaattgaacgaggttcatatggatttagaaatgatgctggatgaagattacaaagaaggaatttgctttattgactttagtcaaattgctctttcaactgctctggtaaacttcccagataaagaaaaaattaatttatcaatggttcgtcatttgatattgaactcaattaagtttaatgtcaaaaaagcaaaaacgcttggatacactaaaattgtactgtgtattgataacgcgaaatctggatactggcgtcgtgatttcgcttattattataagaaaaaccgtggaaaagcacgagaagaatctacttgggactgggaaggttattttgaatccagtcataaagttatagatgaattgaaagcttatatgccatacattgttatggatattgataagtatgaagcagatgaccacattgctgttcttgttaaaaagttctctttagaaggacataagattttaatcatttcatcggacggtgactttactcaacttcacaaatatccaaatgttaagcaatggtcaccgatgcacaagaaatgggttaaaattaaaagcggttctgctgaaattgattgtatgactaaaattcttaagggtgacaaaaaggataacgttgcttcagttaaagtacgatctgacttttggtttaccagagttgaaggtgaacgaactccttcaatgaaaacttcaatcgttgaagctattgctaatgaccgtgagcaagctaaggtgcttctcacagaatctgaatataatcgttataaagaaaatttagttctaattgattttgattatattcctgataatattgcttcaaacattgtgaattactataattcatataaattaccaccgcgtggcaaaatttattcatattttgtaaaagcgggtctttctaaattaactaatagcattaatgaattttgaggtgaataatggctaaaaaagaaatggttgaatttgatgaagctatccatggcgaagacttggctaaatttattaaagaagcatctgatcataaactgaaaatttccggttataatgaactgattaaagatattcgaattcgtgccaaagatgaacttggcgttgatggtaagatgtttaatcgtctattagctttgtatcataaagataaccgtgatgtgtttgaagctgaaactgaagaggtagttgaactttatgacacagttttctctaaatgatattcgtccggtcgatgagaccgggctttcagaaaaagaactttcaattaagaaagaaaaggatgaaattgcaaagcttcttgaccgccaagaaaatggatttattattgaaaaaatggtagaagagtttggaatgagttatcttgaagctacaacagcattcttagaagaaaattctattcctgaaactcaatttgctaaatttattccttcgggtataattgaaaaaattcagtcagaagccattgacgaaaatcttttacgtccttctgttgttcgttgtgaaaaaactaatacattagattttctactatgattaaactccgcatgcctgctggtggtgaaagatacattgatggtaaatcagtttataaattatacttaatgataaaacaacatatgaatggaaagtatgatgttattaagtataattggtgcatgcgggtgtctgatgccgcttatcaaaagcgaagggataagtattttttccagaagttatcagaaaaatataaattaaaggaacttgctttaatctttataagcaatcttgttgctaaccaggatgcttggattggcgacatctctgacgctgatgcacttgtgttttatcgtgaatatatcggacgcttaaagcaaattaaatttaagtttgaagaagatattcgcaacatttattattttagtaaaaaagttgaagtttctgcttttaaagaaatctttgagtataatccaaaagttcaatcaagttatatttttaaactacttcaatcgaatataatttcgtttgaaacgtttatcttgcttgattcgtttttaaatataattgataaacatgatgaacagactgataatttagtctggaataattattctataaagttaaaggcttatagaaaaattttaaatattgattcacagaaagctaaaagtgtttttattgaaactgtgaaatcttgcaagtattgatatgaatatagtatattggtttacatttgaagaccgtgtcaaaaataagactccaccgtactactatatcggtagtaaattaaattgctcatttgagaacggaataatatatgactcttccggaaaggaatactggagctcatgtaaacaaaaaagatttttgaatgcgctaatgcttcaaaaaccgagcgttaaaataattcaaattgatgatgacttggatgttattgaagcagaacgaaaataccaacttgaagtaaatgcaagagataatccagactattttaatctggtatatgctggtggtggatttggtgtgagtggtgaaactcatccagccaaagacccggaagttagagagcatatgagattggctaattatatgaaccgtgacgattttagaccttggaaaacatcacgagctaatatagagtcttggaaattatctcatattgcttacgagaattatgtgttattattatcctctaatctgtacggtaaaactcctggatggcgaagagttaaaggtaatataaatataactgatacaactgctaaatcgatggtaaagtatttcaacttaggttggatacctctcgaagacccagagtattgcgaattatgccagctatgaggtaaagtgtcatagcaccaactgttaattaaattaaattaaaaaggaaataaaatgtttaaacgtaaatctactgctgaacttgctgcacaaatggctaaactgaatggcaataaaggtttttcttctgaagataaaggcgagtggaaactgaaactcgataatgcgggtaacggtcaagcagtaattcgttttcttccgtctaaaaatgatgaacaagcaccattcgcaattcttgtaaatcacggtttcaagaaaaatggtaaatggtatattgaaacatgttcatctacccatggtgattacgattcttgcccagtatgtcaatacatcagtaaaaatgatctgtacaacactgacaataaagagtacagtcttgttaaacgtaaaacttcttactgggctaatattcttgttgtaaaagacccagctgctccagaaaatgaaggtaaagtatttaaatatcgtttcggtaagaaaatctgggataaaatcaatgcaatgattgcggttgatgttgaaatgggtgaaactccggttgatgtaacttgtccgtgggaaggtgctaactttgtactgaaagttaaacaagtttccggatttagtaactacgatgaatctaaattcctgaatcaatctgcgattccaaacattgatgatgaatctttccagaaagaactgttcgaacaaatggttgacctttctgaaatgacttctaaagataaattcaaatcgtttgaagaactgagcactaagttcagtcaagttatgggaactgctgctatgggtggtgccgctgcaactgctgctaagaaagctgataaagttgctgatgatttggatgcattcaatgttgatgacttcaatacaaaaactgaagatgattttatgagctcaagctctggcagttcatctagtgctgatgacacagacctggatgaccttttgaatgacctttaatagattatattactaattaattggggaccctagaggtccccttttttatttcaaaaatttttcataaaacggtttacatccttgtccttccatggtactatacaactatcggcaatactgctgataattaaagaggaaaataatatggctaaagttgatattgacatcgttgattttgaatatattgaagaaattattcgtaatcgttatcctgaacttagtatcacaagtgtacaagattctaagttttggagtattcaaatcgttattgaaggtcctttagaagttcttgagcggtttatggctaatgaatactgcgatggtatggatgctgaagacgtagaattttacatgggactgattgaacaataattatcaaggggctattaagcccctattaaaatgaggaaaatcaaaatggaaatcggcaaaaaatacgagttaaatccacatcgtattaaatctttcattgatattagttcatcaaatgctagtatggtcggcatcattcaagaaaatggcggttggtttgaagttaaatcaatatcaagtttagatggctttgattatgtaaccgaaatcatttgtgctaatggtgaaatctataatgatgatggtatgggtgatgattattttgaacttagtgaagaagagttttattgtttccgcgaatataaagaaccgacttctgaagaggatgaagtcaaagacaaggtttctggcgtaacaaaaattcactgcattgttgacgaaaacaatgcagatgaaatcattgaacttttgcgaaaaactttcaaaaagtagtttacatcagggtagtagtgtgatactattaccctatcaaaactaatggagaaaagaaaatgttcgcaccttatattatggcagcagttatgttggtctgtttatatcttttgattaaagcttgctaaggagaataaaatgagattacaacgtcagagtatcaaagattcagaagttagaggtaaatggtattttaatatcatcggtaaagattctgaacttgttgaaaaagctgaacatcttttacgtgatatgggatgggaagatgaatgcgatggatgtcctctttatgaagatggagaaagcgcgggattttggatttactattctgacgttgaacagtttaaagctgattggaaaattgtgaaaaagtctgtttaaggaaaataatatgatttttgtatttgaatttatgaatgatgaattcgattatgcaatttttaacgcattgcataatcctgatttaagtgaatttaatgaaatgttttctgatgctttgagtatgtcagaagaatactgtggagaatgtcaacgtgtttgtgtgacagtttttgaaaacaaagaaaagacgtatgaagaattattctttgatgctaataaagccactgaatggtttatcgaaagaggatttgcgtaatgattaaattggtattcgcttattctccaactaaaacagttgaaggctttgacgaattagcatttggtttaggtgatggtttaccatggggacgagttaaaaaggaccttcagaattttaaagctcgtactgaaggtacaattatgattatgggtgctaaaacgttccagtcattatctacattacttcccggtcgtagccatattgtggtgtgtgaccttgagcgtgattatcctgtaactaaagacggcgatttagcacatttctatattacttgggagcaatatataacttacatttctggcggcgaaattcaagtgtcaagccctaatgtaccattcgagactatgcttgatcagaattccaaagtaagtgtaattggcgggcctgctctgttatatgctgcgttaccttatgcggatgaagtagttgtttcccgcattgttaaaaggcatcgtgttaattcaacggttcaattagacgcaagttttcttgatgatataagcaagcgtgaaatggttgaaacgcattggtataaaatagatgaagtaacaacccttacggaatcagtatataaatgaaataacacgtggcggaaaatatgaattttaattattaccctattctattagaagaagacgcgaaacagccaaagtggcagggtcctcagtttattaaaggtgtctatcaattagtagttcctaaagacaagatttatagcagttgtttcactgaatccgcttgcagtattttcggtaatagttctccgtattggaattttgacataaagctggatagaaatatcgatatttggttgaaagctatggatattggtaatatcacgtttgatgagaataattatcatattattggtcgcttttccaaacgcggtaaagaattatatttcacgcctgaaattgagagaaaatttgatgctaaaccgtattgattatttagcttcataaaatgtattataatttatataaggtactaaatgaaacaataccaagatttaattaaagacatttttgaaaatggctatgaaactgatgaccgaacgggcacaggaacaattgctttgttcggtactaaattacgctgggatttaactaaaggttttcctgcagtaacaactaagaagctcgcctggaaagcttgcattgctgagctactttggtttttatcaggaagcacaaatgtcaatgatttacgattaattcagcatgattcgttaatccaaggcaaaacagtttgggatgaaaattacgaaaatcaggcaaaagatttaggataccatagtggtgaacttggcccaatttatggaaaacagtggcgcgattttggcggtgtagaccaaattatagaagttattgatcgtattaaaaaactaccaagtgataggcgtcaaattgtttctgcgtggaatccagctgaacttaaatatatggcattaccaccttgtcatatgttctatcagtttaatgtgcgtaatggttatcttgatttacaatggtatcaacgcagtgtagatgttttcttgggttaattgaggcctaggtataaggtgacttatacttgtaatctatctaaacgggggacctctctagtagacaatcccgtgctaaattgtaggactaccctttaataatttcatcaggattagttacttaccgtgtaaaatctgataaatggaattggttctacataaatgcctaacgactatccctttggggagtagggtcaagtgactcgaaacgatagacaacttgctttaacaagttgaagatatagtctgatctgcatggtgacatgcagctggatataattccggggtaagattaacgaccttatctgaacataatgcttccatttaatattgcatcatatgctacgttagttcatattgtagctaagatgtgtaatcttattccgggagatttgatattttccggtggtaatactcatatctatatgaatcacgtagaacaatgtaaagaaattttgcgtcgtgaacctaaagagctttgtgaactggtaataggcggattgccttataaattccgctatctttctactaaagaacaattggaatacattcttaaactcaggcctaaagatttcgttctcaaagattatcagtcccacggcgtcttgaaaggaaaaatggcggtgtaatttcaatttaattgcgaggatatatgattttacgatttaaagatacttctggtgcagttctttttacacttcctaatccaagtgagctagaagttccaggaccaaatcagcctattatcatttatggcaaaaaatattatactcataaaatgactcgtgagtattttgataataaaatttctacagttaaaacttcttctgattgttactatgatattactgttttaacggaaaaacaatatgacgaattatcaccgcgcgggccgtctatgtcgggtagtgaataaatataaatccgactttgatgtcaatattcaccgcggtacattttggggaaattacgtcggtaaagatgctggcagccgggaggctgccattgaattattcaaaaaagattttatacgtcgaattaaatccggagaaataactaaagcacatttagagcctttacgtggaatgaggctaggatgcacatgtaaaccaaagccgtgtcatggtgatataatagctcatatagttaaccgattgtttaaagacgattttcaagttgaggacttatgcaattaattaatgttatcaaaagtagtggtgtttctcagagctttgacccgcaaaaaattattaaagttttatcttgggcagctgagggaacatcagtagatccttatgaattatatgaaaatattaaatcatatctccgtgatggaatgacaactgatgacattcagactattgtcattaaggctgctgcgaattctatttcggttgaagaacctgattatcaatatgtagctgcacgttgtttaatgtttgctcttcgtaagcatgtttatgggcagtatgaaccacgttcatttattgaccatatttcttactgtgtaaatgaaggtaaatatgaccccgaattattgtcaaaatattcagcagaagaaattacatttttagaatcaaaaattaagcacgaacgggatatggaatttacttattccggggcgatgcaattaaaagaaaaatatctagttaaagataaaaccactggtcaaatttatgaaactccacagtttgcatttatgactattggaatggcattgcatcaagatgaacctgttgatagattaaaacatgttattcgtttttatgaagcagtatctactcgacagatttcattaccaactcctattatggctggttgccgtactccgactcgacagttcagttcatgcgttgttattgaggcaggagattcattgaagtctatcaataaggcttccgcttcgattgttgaatatatctctaaacgcgctggaattggtattaacgttggtatgattcgtgctgaaggttctaagattggcatgggtgaagtacgccatactggtgttattcctttttggaaacattttcagactgctgttaaatcatgttcacagggtggaattcgtggcggcgctgctactgcttattatcctatttggcatttggaagttgaaaatcttctcgttttgaaaaataacaaaggcgtagaagaaaaccgcattcgtcatatggattatggtgttcaactgaatgatttgatgatggaacgattcggaaagaacgattacattactttgttcagtccgcatgaaatgggtggagagctttattattcttattttaaagacaaagaccgtttccgtgaattatacgaagcagcagaaaaagaccctaatattcgtaaaaagcgtattaaagcccgtgaactatttgaattgctcatgactgaacgttcaggaacagcaaggatttatgtacagttcattgataatacgaataactatactccgtttattcgtgaaaaggcacctattcgtcagagtaacttgtgctgtgaaattgctattccaacaaatgatgtgaatagtcctgatgctgaaattggattgtgtactctctctgcattcgtactagataattttgactggcaagaccaagataaaattaatgaattggcagaagttcaagttcgtgctcttgataatctgttggattaccaaggatatccagttcctgaagcagaaaaagctaaaaagcgtcgaaatcttggcgtaggtgttaccaactatgcagcttggctggcaagtaactttgcttcttatgaagatgctaacgatttaacgcatgaactatttgagagattacagtatggactcattaaagcatccattaagctcgccaaagaaaaaggaccttgcgaatattattcagacactcgttggtctcgaggcgaattacctatcgactggtacaataaaaagattgaccaaatcgcagctccaaaatacgtttgtgactggtcgtcgctgcgggaagaccttaagctctttggcatccgtaatagcacattatcagcacttatgccatgtgagtcatcttcccaagtttctaacagtacaaacggtatcgagcctccacgtggaccagtctctgttaaagaatcaaaagagggctcctttaatcaagtcgtgcccaatattgagcataacatagacctttacgactatacatggaaattagctaagaaaggtaataaaccttatcttacgcaggtagctattatgctgaaatgggtatgtcaatcagcttcagcgaatacatattatgacccgcagatttttccaaaaggaaaggttccaatgtcaataatgattgatgacatgctatacgggtggtattatggcattaaaaatttctattatcataatacccgtgatggttctggtactgatgattatgaaatagaaactccaaaagctgaagattgttcatcctgtaaattatgatataatttgactcacggacgagtcaccaactattaactaagtggaaaatttatgagcacagtttttaatacaaacccagttgatgttttaaaagaacctatgttttttggttcaggtcttggtattgcgcgttatgatattcaacggcatcgagtatttgaagaacttacagagaagtccttatcatttttctggcgcccggaagaagtaaacttaatgatggatgctgcacagtttaataagcttcctcagtatcagcaaaatatttttactaacaacttgaagtatcaatcacttttggatagcattcagggtcgtgcgccgtctgctgtacttatgtcattaatttcagacccaagccttgatacgtggattgctacatggacttttagtgaaactattcacagtcgttcatatacacatatcatgcgaaatctttatactgatccatcgaaggtatttgatgagattgtattagatgaagctattatgaaacgtgctgaatccattggacgttattatgatgatgttctgattaaaactcgtgaatgggaaaatgctaaagaatttgtagaactatctaaagaatctcctgatgccgactttcgtttaaaccgagctattaaacaagaagccgaagctaaacgtgctttaatgaaatctctttacctctgtttgcacgttattaatgcattagaagctattcgtttttatgtatcctttgcgtgtacctttaacttccataagaacatggaaatcatggaaggtaatgccaagattatgaagttcattgcgcgtgatgagcagcttcatcttaaaggcacccaatatattattcgtcaacttcaacttggcactgatggcgatgaatgggttaaaattgctcaagagtgtgaacaagaagcagttgatattttcatggaagttaaccgccaagaaaaagattgggcagttcatttatttaaagatggagatgttcctggattaaatacaaatagcatgtggagctttattgattacttaactgtatctcgtatgaagcagtgtggtcttccatgcccaattaccgatgctccggttaaacatccatatccttggattcgtgaatatcttaattctgataatgttcaatctgcaccacaagaagtagaattgtcatcttaccttgttgcacagattgataatgatgttgatgataaagttatgatgagttttaaaaaatacttttaaggagtgggccgcaaggcccattttattatgaaagaaattgcaacagaatattcatttattaaatatactgagctagaattagacgacaacggaagtataaaacaattatctattccaaacaagtataacgtaatttatgctattgctataaatgatgagcttgtttatattggaaaaactaaaaatttacgtaaaagaataaattattatagaactgctattaaccgtaaagacaaaacgtctgattctactaaatctgcattaattcattctgcgctaaaggaaggaagcaaagttgaattttacgcccgccaatgttttaatctttctatgacaaatgagttaggtacaatgacaatcgcaacgattgacctagaggagccgctattcattaaactgtttaacccgccttggaatattcaacacaagaaaaaatgatgcttccacatggagtgtggtactatattcaaaacacaaaagaggatacacaatgcaagaactttttaacaatttaatggaactatgtaaggattcacagcgtaagtttttttactcggatgatgtaagtgcatctggaagaacttatagaattttctcatataattatgcatcttattctgattggttacttccagatgcactggaatgtcgtggaattatgtttgaaatggatggagaaaaaccggtaagaattgcctctcgtcccatggaaaagttttttaacttgaatgaaaatccattcacgatgaatatcgatttaaatgatgttgattacattctaacaaaagaagacgggtctttggtatcaacttatttagatggtgatgaaattctgttcaaatcaaagggttcaatcaaatctgagcaggctttaatggctaatgggattttgatgaatattaatcatcatcggttgcgcgatagacttaaagaattagctgaagatggatttactgctaacttcgaattcgttgctccgacgaatagaatcgttcttgcttaccaagaaatgaaaattattttactgaatgttcgtgaaaacgaaacgggtgaatacatttcatacgatgatatttataaagatgctgctcttcgtccatatctagttgaacgattcgaaatcgatagccctaaatgggtagaagaagctaaaaatgcagaaaacatcgaaggctatgttgctgtgatgaaagatggttctcattttaaaattaagtctgactggtacgtgtctcttcatagtacaaaaagttcattagataatccagaaaaattgtttaagactattattgacggtgcatcagatgatcttaaagcaatgtacgctgacgatgaatattcatacagaaaaattgaggcgtttgaaacgacttatctgaagtacttagaccgagctctgtttttagttcttgactgtcacaataagcattgtggtaaagatagaaagacttatgcaatggaagcgcaaggtgttgctaaaggtgctggaatggatcacttgttcggtatcattatgagtctataccaggggtatgatagtcaagagaaggttatgtgcgaaatcgaacagaattttttgaaaaattataaaaaatttatcccagaaggatactaagctgtttacaagtccctcgtgttgtgttatagtagtcttactgacataacatgaggactttatgatggatttgcagcttattactactgaaatggtcgttaaagcatacggtgatactacagatgggatttctgtatttaaaggaaatcgtcgagttggatatatcaccgatcttaagaaagatttagctaagcaagtcaagcggaaaacgaccattaaagaatatcgaaatcgtcgtcttgagcaagcccgtgatatgcttcctgatgcggttgaggagatgaaagtctttttagaaaatcagcttgcgaaatatgattgcgatgtgttcattaatcagactcaacctaatgttcatattaacaactgtaaatgctatatcatcgttaatcctttaacgggaaaacatcgtcttggaattagtaatccaaatcgtagcgcatcggatatggcagaagatgttgaggcatgctttaaaatttctaaatctccggctgaacatcatattttaattaacggtctttctcaagacgatattatagaggttattaaaactttatgcaattaagtaatacgacagcaggtttgctattaattgtaattgcattaggcggaacttctttaattttaaaaaataaaattgaaagattagaaacgtctgttgtagaaattacaaaaacggccaatgaaaacgccttagcattaaataatttgcgaattcagtataattatattgatgcgatgaataataaaaatcgtgaggcgattgctgctattgagcgtgaaaatgaaaaactgcgcaaagatgcaaagaaggcggatgtggtggctcgtaagccaggattggttgaaaaacaaatcaacaactccttcaacaagttcgcagaagacatccaggacctttctaaatgattagactatcagcagtaatattatctatcggtcttctagctggttgttcgacaaagcctctagaagtaaagaaagaaacagttcatcctaattggcctgtacaaataaagtcatatgacgaagctaaattatcttggcaagttaaagttattgatggcaaagcttgggtcggtatgccatttgaagattctcaggaatttcgtatttggcttaatgatgtaaaacgatatgtacatgaccagaaaactatgatatgttattatcgtcaagagttaaaagaggataaatgtaaatgatttcatggcatcaatttgaacatctcaaaggattgatttatgaatccgagatggctgcaatgatttatggacgccagattcagcgattagaatctttacctccaactaatgatgttttattagctcaatcacgtgctaatcttaaaaatgaataccaaaataagtggggcaaagcatctaaagacctgcatgattatattcaatcattagttgagaaaaataaatgaaaactctgctagaacgttatattgaatgctcagaccgttacattgatgcatgtcatggtgcagtatacatggatttggatcgtggaatagtattaaatgatgaagaccctgctaaagctttagatgatgctggtaaagccctgcgaaaagaagcgaaagctcgtgggcttgatatgtatcagcttaaaaatcacatgataaaatttatttcatccaatgttcagagtaaatcagcgaatcaatcaacagctgaattgtacaaaggacggtgtgagcacaatattcgtattcttgaagttttcttaggaattaaatgatgaaaaagattattttgactattggctgtcctggttctggtaagagtacttgggctcgcgaatttattgctaaaaatccagggttttataatattaatcgtgatgattatcgtcaatccatcatgggtcatgaagaacgcgacgagtataagtataccaaaaagaaagaaggtatcgtaacttacatgcagcatgatgttgctaacatgattctctgccaagacgcaacgaagggtgtaattgtttcagatactaatctgaatcctgaacgacgtaaggtctgggaagagtttgccaaagagcttgggcatcaaattgaatataaagtgtttgatgttccttggactgaattggttaaacgcaactcaaaacgcggaactaaagcagtaccaattgatgttttacgttcaatgtataaaagcatgcgagagtatctcggtcttccggtatataaagggactcctggtaaaccaaaagcagttatttttgatgttgatggcgcgttagcaaaaatgaatggtcgtggtccttatgaccttgaaaaatgcgataccgatattattaatccaatggtcgttgaactatccaagatgtatgctcttatgggttatcaaatcgtagtcgtttcaggccgtgaaagtggaaccgaagaagatccaacgaaatattatcgtatgacccgtaaatgggttgaggacattgctggtgttccattagtcatgcagtgtcaacgcgaacaaggcgatacccgtaaagatgatgtagttaaagaagaaattttctggaaacacatcgcaccacattttgatgtgaaattagctattgatgaccgaactcaagtagttgaaatgtggcgccgcatcggtgttgaatgctggcaagtcgcttcgggagatttttaatggcttggcaccatgaaacttgggctattgttattgtaaatagcggtttagttggtactagtaatgggcaattttgtgtatttactagtgaaaatagagcatgggaggaatgccttaaattaagagaaaagaatcctgatgttgaactagtagtaaagaaaactaaactgcctttaccatggaaaacgtatgaataacctagaaaagatttatcgtctttgtgataaaattgaaaaagaaaagaaatatctattttgtctatggcctattgttgacggaagagtaggcctagatgttcttgattatgaaacagaagacaaagtagatggcgcaacttttgataacgctttggatgttattgattggctcgaagaaaattatgtgaggtaaatatgtttccgacttactctaaaatcgtagaagtagtgtttagccaaattatcgctaataatatgtttgaaaaacttgataacgcagctgagcttcgaatccacgctcaagtgactcatgtattgaacactttgcttccagaccaggtggattctattgccattacgttgtatccaggttccgcgcatatcattgttgtattcggtcttgatgctgagctagttatcaaaggcgacattcgctttgaatctcaaactgcggaattcaaagcgatttaatggtttactttacggtagagttgtgatattatagctctaccaaaacaaatgaggaaattgaaatgagcgaatggtttgaagaagataaggtttatcgctttaaaactgggtataaagatatttttaatgaaacttgcggggctaataaacgaatcgcccagtttattggggaaaattcatttaaagtaaaaattgaccctgcaaagaatgttattagcattaaacgcgaaattgatgattgttggtataaagctgttgatgtaatgggtgaatcctataaagttagcccgttattttcaattgcttatatgttagaatattcttttttcgaagaagttcaaaaagatgattctgtcagtaaatttgaaattaaaactgataaagaaattaagtggaaagtagtaggtattactggttgcatgttttatatctatgctcaaactgatacaaaggaagaagctaaaaagaaagctctagaatatcttgaagagtatgaagaaggcccggtaatgattacccaagatgctgaattagtttctgtcaaattagttaaaaacgttgaaagtaaggagctgggatcaacatgctaagcgaaaaaccaattactgttaaagaattccaagaaaaagttaaactatttgctcaagaattggtaaataaggtttctgaacgatttcctgaaacgtcggttcgtgttattaccgaaactcctcgttcggtattagtaattgtgaatccaggtgatggtgaccaaataacacatctcaaattggattttgatggattagttgaagcacaaagggtgtatggcgtactatgatgaatttaactgatataattgataattgtcttgaaaatgatactggcgatcatagagcgcttgactctgaaacagcaaagttcattagaataactttaatgaatgatactctggtgaatagtattcatccttctgtgtatgatgctattattgtgacgaagtatccagttgagcttcacaaaaagatggttggcgcaatttttattgataagaaaaaccgctttaaagatgggcagaatataattagttctgttattaaaagtataactaaacttcgtcacgaaatttatcgtgttgaaactgctaaatctgcttatctggtgattatgaaatgaaagcgagtacagtacttcaaattgcatatttagtatcacaagaatcaaaatgttgctcctggaaagtaggagcagtaattgaaaagaatggacgtattatttctactggatataatggttcacctgcaggtggtgtgaactgctgtgattatgctgctgagcaaggttggttgctgaataagcctaaacatactatcattcaaggtcataagcctgaatgtgtatcgtttggttcaactgatcgttttgtattggcgaaagaacatcgtagcgcgcactctgaatggtcgtctaaaaatgaaattcatgctgaactaaatgcgattttgtttgctgcacgaaacggttcttcaattgaaggtgctactatgtatgtaacactttctccttgcccagattgtgcaaaagcaatagctcaatctggaattaaaaagctggtttattgtgaaacatacgataaaaataaacctggctgggatgatattctgcgaaatgcaggtattgaagtgtttaatgttcctaagaaaaacttaaataagttaaactgggaaaatatcaacgaattctgtggtgaataatgaaatttcgtttggtacagctcacagcaattagttcttattccaacgagaacatttcatttgctgtagagtataagaagtattttttctctaaatggaagcagtattataagtcaaactgggtttgtattgatagaccacatagttggaaatctgatttagaaaaatgccaaaaattactttccactcttaaagaacgtggaacaactcatattaaaactgtaataggtaaataaatgaaactgacgactgaacaaaaagtagcaattcgtgaaattttgaaaactaaattgtccatgggtgtttcaaacgtagtttttgaaaagtctgatggtactattcgtgttatgaaaggtactcgcgatgctgactttatgccaaccatgcaaactggtaaattgactgaatctacccggaaagaatctactgatatgattccagtatttgatgttgaacttggtgcatggcgaggtttttctattgacaaattgatttccgttaatggtatgaaagttgagcatttgctccaatttattggtaaataaatgctttaagaattatttgttattattaattcatctgttaacaaaaaggaaaaacgatgtctgaagtacaacagctaccaattcgtgctgtcggtgaatatgttattttagtttctgaacctgcacaagccggtgatgaagaagttacagaatcaggacttattatcggtaaacgtgttcaaggtgaagttcctgaactgtgtgtagttcactctgtcggtcctgatgttcctgaaggtttctgtgaagttggtgatttgacttctcttccagttggtcaaattcgaaacgttccacacccttttgtagctctgggtcttaagcagccaaaagaaattaaacaaaaattcgttacctgtcactataaagctattccgtgtctttataagtgatataaataataatatgaattgggtgtcggaataataagttaaccgaacaattctatgtggtagtctacaactgagagatctgtcgaaagaagatgaaattcagaagaacgtgactaccgagttttaatctctaacgagaatttttaaatgattaaacaattacaacacgctcttgaactgcaacgaaacgcatggaataatggtcacgaaaactatggcgcatctattgatgttgaagccgaagctcttgaaatcctgcgttatttcaaacatctgaatcctgctcaaactgcattagctgctgagcttcaggaaaaagatgaacttaaatatgctaagcctctggcttctgctgcacgaaaagcagttcgtcactttgtggtaacattgaagtaatttattggagattcactgccttagtgtgagctaaatcgaggagccgtcgaactgtctgattaatgatttgcgaatcattatagttttaagaccccggcagttttacggtgtacctcttgaatgtgaatgatgacgggtttatggttatcctggtcgttaaatatccaaaaacctatgttccccttgagggcttgcgcaggcaatgccaataagtcctgcattttcatttaaaagagaatttataatggcaaaacaagctaaagcaaagaaagcagttgaaaagaaagttggtgattctaaacgcgctggctacaagcgtgggtcgaactctcgtatcaatcaaactgttgagaagatcatgcgccgagcacgtgcggttcttcgagatgatgcttctcgttttggtaagcagaaagcataagttgaggactccttcgggagtccttttttattttccaaagattgcataaagttgtttacagtatggttcctttgtgatagtattatcttacacaaacaaaggagaataaaatgaaaacgattaatctgaacgctgcagttaaaactaaatgcttcaatggtaaatatgatgaaactatgtggttcttaatggcagttgaaggtgatattattgaagtagaaacaacagaaggtatgggaacagatttcacctttacaattcaagttcataatttctttactggttggatttatgaattgaatacagtaatcgttggaaaaattgaacaaaatgaattaggtgaatggtattatgttacagctcgccaacgtgccgaacgcttaattgagaagatgaaaaaagttggtaaacttgatatgcagcattggaaagtagtaaaataattgtttactttggtacaggatatgatattatatacctgtaccgcaattaaacatcttggagaataaaatgaactacatcaactttgaacgtaaatatgtttctaatggtattacaggttctattgataccatctgcctttggaaacatcaaaatggatcagtatgcgaaattgaacagtacatgactcctaattacgtttatatgcgatttgaaaacggtatcacggtttcaatcacgatggaaggttccaactttaaaatcgctctggatgatgatttccgtgaacgcgatttagggactcatccttgctggaatggcgttaatcgcaagcttttggttaaaacttggattcgtcatattctgagtaacagagctaaacctgagcatcttgaagcaatctttgatgtagttcttaacgaatttgatatttaaaataaatgaggggctttggccccttactgaggaaaatgttatgtttatgaccacttattttgatactcgtaaaaacttctgcgaagtagttttctcaaaggcgcctaaagaccttcctgcacatttgcagcctactagcgaatcgattaaaaactacgttgatgtggtttgtcctttagagtttcgtactgtaaatgggcgcgatactttagctatcactaaactcaatcgtgaaattgacattgacccctcaattgcacgtgaaattaatagttctgatattaatggcggtaatgttaaatcgcacggttttcagatgaggttttaatgaaattctttttaggtcaaactgttgaattaaagggagttggtatacctggattaatttctaaggttctacctccgtttaaatggagtggtattcaaataaaagaggcttatattgttttctgggtagatggaaatgaagaccttcgtatgggtgatgaattatctcctatctacggattaaaggaaatagtatgaatataattaataagatttttggaattcagtacattaaggtcacatataaagtaacagataaaaatccgtatactgatgaacatgaagaaccgcaagttgagtctattatattagaaaaggaccctaactggccagttgaatttcgtcttccttgctatggtcattgggctgatgttgaaattataagcattgaaaatgtctgagttagagattagaagcaattttaggtggccatcatgtgcattaagtaatttcgcccattggcctttcgttatggatggcattcaatttggaggtcttgaaggattcctccaaggatgcaaggtgaaaaacgttgaacaacaacgtcgtatatttgggttatccgggcttgccgctcaacaagctggaaggtcttatgcaagagctcaggaccgtgggaccctcttctggcttggagttccattttcaagatactccccggcgtggaaagaattatacacaaatgcatattttgaagcagcgatccaaaacaagggcttccgtgatgcattacaagcctcgaaaggaaaagttttgaagcacagcatggctagtggtctaacaaaagatgatacaatactaaccgaagctgaatttattgatgtgttaaacctattaagagactctctatgaagcctactattttaactgatattgatggagtatgtttaagctggcaatcaggccttccttattttgctcagaaatataatcttccgttagaacatattttaaaaatgatccaggatgagaaatttatttctcctggtaaactctttaattgtgacgaagaacttggcgttaagctaattgaaaaatacaatcgttcagattttattcgttacttgtctccatataaagatgctctgtgtgtaattaacaaattaaaagaagattataattttgtagctgttacagcattgggtgattctattgacgctctgctgaatcgtcaatttaatttgaacgctctttttcctggtgccttctcagaagtactgatgtgtggtcatgattcttcaaaagaagagttgttcaaaaaggcaaaagagaaatataacgtaatttgttatattgacgatctcgctcaccattgcgatcatgcgagtgaaatattaaatgttcctgtttattggatggctcgaggggagcgtgacaatattccaaaaactgctcagcgagtttatacatggaatgatgtagagaataagattttttcgccgaaggaaaataaagaaagttttgatcgtgaaaaagctataaaagatgcaatcgagaagatgattaaaaacgattcttttccttggaacactacctggagaacgcctggatttaatccttataatcatctatatcatccatatcagacacatccgtttcagacatggaactatattaaacctggtggcatagagtatttgtataatagacctactagtggtgataatattttccaaggagcattctaatgtttgttgttcacactatttatgaaaatgaaggtaatactacacgtgattacggtcacgtaaatcaattttttagatgcaatccagaattccgagctcaaaaagacgaacgaatttttaaaaaatgtgtagagcaaggtttcatttacgtcaagcactggatgcaaggaaataaagttagaaccacatatcataagtctttgactgagcttaatgatgaattgatttataatagagctgtaaaccaaactctgaaggatgaataatgattcttaaaattctgaacgaaatagcatctattggttcaactaagcagaagcaagcaattcttgaaaagaataaagataatgaattgcttaaacgagtatatcgtctgacttattctcgtgggttacagtattatatcaagaaatggcctaaaccgggtattgctacccagagttttggaatgttgactcttaccgatatgcttgacttcattgaattcacgttagctactcggaaattgactggaaatgctgcaattgaggaattaactggatatattactgacggtaaaaaagatgatgttgaagttttgcgtcgggtgatgatgcgagaccttgaatgcggtgcttcagtatctattgcaaacaaagtttggccaggtttaattcctgaacaacctcaaatgcttgcaagttcttatgatgaaaaaggcattaataagaatatcaaatttccagcctttgcccagttaaaagctgatggagctcggtgttttgctgaagttagaggtgatgaattagatgatgttcgtcttttatcacgagctggtaatgaatatctaggattagatcttcttaaggaagagttaatcaaaatgactgcagaagctcgccagattcatccagaaggtgtgttaattgatggcgaattggtataccatgagcaagttgaaaaggagccagaaggcctagattttctttttgatgcttatcctgaaattagtaaagctaaagaattcgccgaagtagctgaatcacgtactgcatctaatggcatcgccaataaatctttaaagggaaccatttctgaaaaagaagcacaatgcatgaagtttcaggtctgggattatgtcccgttggtagaaatatacggtcttcctgcatttcgtttgaaatatgatgtacgtttttctaaactagaacaaatgacatcaggctatgataaagtaattttaattgaaaaccaggtagtaaataacctagatgaagctaaggtaatttataaaaagtatattgaccaaggtcttgaaggtattattctcaaaaatatcgatggattatgggaaaatgctcgttcaaaaaatctttataaatttaaagaagtaattgatgttgatttaaaaattgtaggaatttatcctcaccgtaaagaccctactaaagcgggtggatttattcttgaatcagagtgtggaaaaattaaggtaaatgctggttcaggcttaaaagacaaagccggcgtaaaatcgcatgaacttgaccgtactcgcattatggaaaaccaaaattattatattggaaaaattctagagtgcgaatgcaacggttggttaaaatctgatggccgcactgattacgttaaattatttcttccgattgcgattcgtttacgtgaagataaaactaaagctaatacattcgaggatgtatttggtgattttcatgaggtaactggtttatgaaagcttacttagaaacaattgtcattgctcaaaaagaaggtggagatgtttctacttctgtatcacaagtcattctcgaatttgtagatgcatacgcttataataaatttacagaaacatttgatgcctatgaaaaaggaccaaagtttgaaatatatcgtactctcttaccactagattactaaaggccttcgggcctttaattttataaatagaataaacactagagaggctatgatggaacttattacagaattatttgacgaagatactactcttccgattacaaacttaaatccaaagaagaaaataccgcaaattttttcagttcatgttgatgatgcaattgaacaaccaggctttcgtttatgtacctatacatctggaggtgatactaatcgcgatttaaaaatgggcgataaaatgatgcatattgttccttttacattaactgctaaaggttcaattgctaaattaaaaggtcttggtccaagcccaattaattatatcaattcagtttttactgttgcaatgcaaacaatgcgtcagtataaaattgatgcttgtatgcttcgtattcttaagtctaaaaccgctggtcaagctcgacaaattcaagttattgctgatagacttatccgtagtcgttcaggtggcagatacgtccttcttaaggaactctgggattatgataaaaagtatgcatatattcttatacatcgcaaaaatgtatcactagaagacattccaggagttccggaaattagtaccgagctctttactaaagttgaatcgaaggtcggtgatgtttatatcaataaagataccggagctcaagtaaccaaaaatgaggcaattgcagcatctattgcacaagaaaatgataaacgttctgaccaagctgtaatcgttaaagttaaaatttcccgtagagcaattgcacaaagtcagtcattggaatcttctagatttgaaacaccgatgtttcaaaaatttgaggcttcagcggcagaattaaataaaccagcggacgcgcctttaatttctgattctaatgaattaacggtaatttctacttcaggatttgcactagagaatgctcttagcagtgttacagctgggatggcattcagagaagcttctataattcctgaagataaagaatccattattaatgcagaaataaaaaataaagctttagaaaaattacgaaaagaatctattacttcaataaaaactttagaaactattgcttctatcgtcgatgatactttagaaaaatataaaggtgcttggtttgaaagaaatattaacaaacattcgcatttaaatcaagatgctgcgaatgagttagtacaaaattcttggaatgcaataaaaacaaagattattcgaagagaattgcgtggatatgctcttaccgctggatggtcactacatcctatagtcgaaaataaagattcatctaaatacacaccagcacaaaaacgcggaattcgtgaatacgtaggttcaggatatgtagacataaataatgctcttttgggattatataatccagatgagcgtacaagtattttgacagcatctgacatagaaaaagctattgataatttagattcagcctttaaaaatggtgatcgattgccaaaaggtattactttatatcgttcacagcgaatgttaccttcaatatatgaagcattggtaaaaaatcgagttttttattttagaaattttgtatcaacatcattatatccaaacatttttggtacttggatgactgattcagctgttggtgttttaccagatgaaaagcgtctaaacatttctatcgataaaaatgatgaagggcttgttaattctagcgataatttagtcggaattggatgggttattactggggctgataaagtcaatgttgttttacccggtggaagtttagcgccttcaaatgaaatggaagttattttgccacgtggattaatggtcaaagttaataaaataactgatgcatcttacaatgatggaacagttaaaactaacaacaagcttattcaagctgaagttatgaccacggaagagctcaccgaatcggtaatctatgacggagaccatttaatggaaactggtgaattggttgcaatgacaggtgatattgaagtagaagacagagttgactttgcatcatttgtttcatcaaatgttaaacagaaagtagaatcatctcttggaattattgcgtcttgtatagatattgcaaacatgccttacaagttcgttcaaggataaatcatggaacttattacagaattatttgacggcgcttcggcgccggttgttaacttaaatcctaagcataaaataccacaaatttttgctattcaagccggcgaagaaagcgtgcttcctggatttagattttgtacatacacctctggtggtgatacgaataaaaacgttaagccaggcgataaaatgatgcatatcgtaatgataggtgttaatgagaaactatcattagttaagcttaaaaacttgggtggaaatccaattggtgtcattaatgccgtttttgatactgctcttcaaacaatgaaacagtataaaatcgacgcatgcctattccgcgtactaaaaagtaaaacaaatggcgcagctcgtcaaatgcaagttattgctgaccgtttagtacgtactaaaggagcaggtcgatatgttcttttaaaggaaatctgggactatgataagaaatatgcatatattatggtttaccgtaaaaatgccaatttagaagacattccaggtgtacctcctatttcaactgagttattcacaaaagttgaatcaaaggtcggtgatgtttatgtagacgttaaaacaggaaatgctgttcctaaagctgttgctgttgctgcttctattgctttagaaaatgataagcgcacggaccaagctgttattcagaaaactaaaattagtcgtcgattagcagcacaagctcaatattctactgttgatgcttcacttcagggtgatagcttcgctgctaagaaatatcaagagtttgaatctaaagttccggtatataaagcagaaggaccaatgaactctggcgttattcagattggttcaaacttcagcaaaggagctatcggtggtatgagaagtgcttctcgttttaaatctaacgattatgaactagaaagcttccgaaatcatattgcattagcccatgcacgtttacgtgatccatctatcaagttgcagagcgatataacatatcaaggttctcaagaatatttaaagaataaagaattctttgattataaaactgataaaattttaagcgatcttgctgatattaatatttctaatagctttgatgttattaagaaaattattaatgatttagttaaaggttctaaaaccacaccagatgaaaagacagctattattcaatttgtaatgaatggcatttataaattgattaatgaatctgctgcccaggcatatgaatacgcaagcaccgaagtagctccaaaaggactgactcaggctgaatctgatgtaattgaagattattgtgcagattcatatgttgaaatgaactcgttccttttgggtaaaccagattctacccgtgaagaatacatggaacgagctattaagcacatcgagacgttagattctgcctttgccaaaggatcagttcttcctccaggaactacactttaccgtgggcaagaagttacctttaaaactttgcgtcataacattgaaaataaaatgttctatttcaagaacttcgtatccacatcgcttaaaccaaatatcttcggtgagcatggtaaaaactatatggctctagatgattccggcgcagtattttctggtgaaggagaaggttccgttgatgcagaagatttgatgcatatgggtagtcattctacatatgctaatgaagatgcagaaactagcgtgggtatggtaattaaaggagctgagcgaatcaaagttatcgttccaggtcatttatcaggatttccatcagaagctgaagttattctaccacgtggaattttactgaagattaataaagtaagtacgtactttatgaaagaaactgcttataacaagtatctaatcgaaggtacaatcgttcctccttctgaacaattagaagaatcagtatatgatggagaccatctaatggaaactggtgaagttcgtccaatggctggatttaatcaattccttgtagaagaatcaaaagaagaggaaaatgaagtttctcaaatcttgacttctttggttaacatcaacggaatgtctaaaaagttcaaaatgtagtttacaagttccttatgttgtgttatagtagtcttactgacataacatgaggaacacaaaatgaaatcttctttgcgctttttaggtcaagaacttgtagttgaaggcgttattcctgctgataatgcttttaatgaagcagtttacgatgaatttattaaaatttttggaacagataaaaagttcggaatttttccttctgaaaatttttcaaagccagaacagactgaaagcattttccaaggtgtagtaacaggtaaatttgagtcagaagctccggtaaaaattgaagtttatattgaagacagtttagttgcttcagttgctgcttttatttcattccgtaaataaaaatatggggaccgaaaggtccccattgttatattgctcctaatattttactttgcgaattgacaattcctgtcatagtattaatgtttgaaatgcttcctgcagttccacctaatctactgagtcgtgaaagcgaattagatagtccagtaacacctccactatttccgagaacgctttgaataccatttatagcagcagattcaagccattcaagcgcagcttgcctatcaactgctccagcctgcatgactctatatgcaaaagtaacatcaaatgtagttatttggttatctccatcatatgataactcaggagcgctcactgacactggaatgcatccggtgaacattaccgcagtatgaggtaatccattgcgagaatgaagattaacctgaatatctgcctcgacatcttgtggcaaagcacgcagtccagttactgggtcttgaacagcgttaacccagtcttgcattgcacgatagttacaagcttctgaatccattctaaatgaaataaccaaagggtctaattctctcccagttatacgaatattaggagagttgtagttccagtcagtttcataggataatctattctctggcatttttacagagtatatcatcaatccagatgagttatatgccatgttaaagaagtcaattaaatatgtaccaactgtaaatgagcctaataaactttgaactgtacgttgactcatggcaccaataagatatttactaacccctgattttcttatcagtttttgtgtgccagcagtaattagcgtggtaattccctgattaatatcgccttgagacaatcctaaccagtctgaatttagacccaagttattataagaaaagttgctaattgaacttatcaacgaagagcttttagttgatggagttgttgcaaaaacgcagctaaacatattattacgttggaaatctgcgtttattgcttgattattaaattcctctaaagaatacattaaaaagtccccgcatataaagaagcacgatttaacgtgataatttctctcatagtaatctcaagagtaaatgtactagggaggtttggagcaatagctaatccgttaaaattaccattcggagttttatcaaatctaatactttgaatttgacacggtccaaacacttctgtttttccgtcaaatttagaagttgcgccaaagtttttaaccatccaaattgtcgggtttgaaactacaagaacgttagttaaactcgatgtcattttctcaaataacgtcttatttttaactgcatcttctggagttaatggctcaataaaagtagaacggtaccactcatctaaatatccttttatttcagcagcatattgagatttaccagtttcaccgtaagaaaaatagttaaaatactgatagatattaataatagccattaaatcttctgttgagcgcggagtcaaatcccaagtgaacactttagttctattttcagcaccgccgtacatgcttctggctgtcgtataaatctgttcattattatcagccattataccttgtgttatactttccagcgctccaaatactgcggttgaagccatattgcttagcacaccagtagcagtacctccaccttttgtaataagactatcttgaacatcattaaatctatgtgatgacgtatcgacgtcagatttagatctaggtaaaagaatatttgcaacaggaactttacttattgttcttgaattattatctgatattagtccatttgatagttttgatactgtattactgatagtgtttctggctgtacgtaaaatactcgaagatgaagaagagtagttagatctcatcgttctaagacttccagaatccctagatgacatattgtatgcagtaaataataatccattcttatatagatctgttacctggaagtcccctgtagtgtcattaccactagcacgcccagttggaaactgggctgtgtatgttttagttcctacttctgatttagtactctgtccggctgaaattgtttcaccggactttttaattaaatcagcagttatttctttaacaattgccatattattccttaattaactcccgtcgcaccaaatacaccaggagcagttgtgcttgtgacaggtgtcatattatgaacgacagtatttttcttaataacattattagtattattgattgaaggagatgcttgttgaacaggagcttgttgtgctttgttcttttcaatcacctggacctgttttgcttctggtgatttagcagaagtttcaggttttgcttcaggttgatttttcttgagctcttgataagtggcatcaattttagcaaatctagaagcaagttcttttttaactgctggtgaattatttaaatccggatcattcattcgttttttaaggtcttcatgagcagcttcaattgatttaactgtcgagtctttgctcatatcagctgaatcagcatatttttcaaaacgaatcatcgcagcacgagcttcattagctttcattaaagcattttttctttcttccggtgaaagttgttttaatttttcttcttctgctgcacgttcttcgtcagtagtcaatgcttctttattatctacaccacgaatccagttagatgcacgagttttccagttcgcaattttgtctaatccttctgctattgggccaagatcatcattcattcgtttatcttgataatttgctactttttcttggtcttctttattaagagatgctccagtagaattttggaaattttctaatgctcttccttctacttcatcagcagtatccttcatgccaggaatgactcgaagaattgctgcagataatttagccatacctaattgaataagctctcctaaattataaagaacacttccaagcccttcaacaatagctactgttaatccgccccaatctccagcttcccagaactttttaatttcatcaatagattcaaagatgctttgtaataaagggccccaagttcctgtttcgcttgagaaagttttaaaatcagtgctaaataaatcccaggcttttgaaaatttatctgaccagtatttaaaatgaaccatcagcaggtctattccaataacaacagccattatcaatgcaaccattttagcagcttcaatagcagcactgacggtatacttaaatagcatgctagatattttatcagtaattgaaatagatttcttaaatccgaaatcaactgtctttgttaatttatctaaagcttgagataattttaagttaaatgcgtctcttttttgcttctcttctggagactcttgttttggttcaattggctgaggagtagggaaaaaatcagcatcaggatcattattaactgcttcaggagccggtaataaaggacccacagattcagctgtatcatcctcgacgactttaacaggaatagcattttctactactgctaaactcgttccagtctgttgaattccagctgtttgaattttttgttctaataaactcgttaatttatctaatttgcttccgagtgattcgcctatttctttattgatattattgccaatttcaacagtctcggcaattaactcagaaccagcagtagtatcactcactgcgctttctacattgtcaattgctccaattatttcattcgatttttcttcgacagtttgagcaattaattcagaagcagcttgagcatcatccaatttcgtagatatatcgttaagcccagataaagtgttggaagcggatttagccgcttcctgtgttggtttattatctgaaataacttttctacgcatcgtttgcatttcttgtggctttttcattcaaataatccaataatattaccaattccagttattggaccattagggccaggaattgctaaagttgtaaaaatatcatttgcccattttaaaacgaatgctggcatctcaagaaaattaatttctttaacttcatcattgaccttaagcaagcatttggataacatatcgctcacagttaaaaattgttcaaattttccaggcggtctaaaataaaatgtatttccttggtattgaaattctaatctttggcatacataaacatcattaatgtcataagtatagccatctatttctttacgagatttaatctttccattaaattccaataaatgaatagaaacgaaatcaacttctgccggtgacaaattcggacaaatagaatcaataagaagttttaaattttcatcagggcctttaacatcttttaaaatgttataatgtttaagacccattttaggaatagaaacttctttattgcttattggaagaactactttcttcagtggtagtatcagatttaaattcatttttaaccttaactgggtctattgtttccagtttcgttgcattagtgaacatatatagatgagttactgaattattatttgataattcatggataacttcatcaacgtaaaattctgttttaaattggtttttactatcattaaaaataattttaacaccaggagtcaagttaaaattaccgacagtagaacatttagcatagccatcatattgcgccatagtttgaagacgaatagcttcttcatagccattcctataagtcatttcagaataagcacctgaccttgacactacaatagagttttcaccctttcctgtagtaatcattggtagtgaagaatctaaaaacgaatgagcatagatagtagcatttttcattggatcacgtttatgcgggtttgatttagtcaaccaaacaaaatcatatgccaatggatattttaattcttggatgaattgacctattaaagatggctcacctacaatcattggatatggttcttgatttatcatcatatcatagtccatcatgttaactcccatgatgtcttgccacacaaatacaaatttgtcacttcctacagctagagcaacttctcttacataggacaaataattttcaaatgtactagtccatggaatatcaggaacataagcatttatagcatttattgctggagttaataatgtgcggtcttgataaatgacaccaagcatttcttttatagattcacctgcatcagggaaaaatggtctaccaaatttaagattttctatagaatgaatagttcccaattcaatagcaatgatgttatcgccttttgaatctactgacacggaaaaatgcttgcatccataaattcgtgttttaacattattaatatcgtttgcattagctacagaaatttgaattatttcatttccatccatttttgtgtggatatttttagaatcataaaactgcagcattccttcatttcgaccataaagagagtcacgcatagttaatgtggtaatagtagcagctaattcaacaaatctattattactccaagcgtcataactctcaaataatttaacgctgagatttggatatccaggacgttgtaacatactcattgatgtttatccttctcaatcagttttaatacgaatccgcgctcggcaggaatcattttcattattgaatttaagctataattactttttacaagcgtgtgattaatttgataaaaagtaaatatctcatctggattaactaatagcttaaacacatctactatatcagtgtattttttaatgtacttatcacaacacgacatgtgcaatgttaaattaataggattcattgcatcgagaattttttctaatgtttctatctcgatggcgtcaacaagttctatttgactcgattcactaatttccttccaatcataccacatttcatctacttgaacagaatgaatattttcagtaatcatctttgctttattttcataaaactcagaaggaaaatttaatttaattttaacattagctacatcaaaaataggttcctttaattctttttgatatatttcaaatggaactgtcttttcttttttacattttggacatacaaatgtgactggtactttagttttacctattgaacctacaaatacctgcaaaaatataaatggttgccaagtcttcggatagtctccaaaataatcatcaattaaatcagtaattatttctttttgttcttgtggtgaccgatgttctatatcgtttcgaactaacaaaaaatctcgataatcttctaccgtaaatggtttaaaacgatgaacaccatctggtaatttacaacgaataatgtttgccatagatgctccttttattctatttataaatatgataaataaaggagctaaatatgtatgaatacaaatttgatgtgagagttggttctaaaataatcaactgtcgcgcatttactcttaaagaatatctagaacttattactgccaaaaataatggttctgtagaagtaattgttaaaaagctaatcaaagactgcacaaatgcaaaagatttaaatcgccaagaatcagaactattgttgattcatttatgggcgcattctcttggagaagttaatcacgaaaactcctggaagtgcacctgcggaactgaaataccaacccatataaatctattacatacacaaatagatgcaccagaagacctttggtatacacttggtgacattaaaattaaattccattaccctaaaatttttgatgataaaaatatagcccacatgatagtatcatgtatagaaacgattcatgctaacggtgaaagcattccagttgaagacttaaatgaaaaagaactggaagatttatattctatcatcacagagtcagatattgtagctataaaagatatgcttttaaagcctactgtttatttggctgttccaattaaatgtccagagtgtggaaaaactcacgctcatgtaataagaggactcaaagagttctttgagttactataatggcaaatattaataagctttattctgacattgacccagaaatgaaaatggattggaacaaagatgtttccagatcgcttggattaaggtcaattaaaaacagtcttttgggaattattacaacaagaaaaggttcaagaccgtttgaccctgaatttggatgtgatttatcagaccagctttttgaaaatatgactcctcttactgctgacacagttgagcgcaatatcgaaagcgcagtaagaaactatgagccacgtattgataaattagcagttaatgtaataccggtttatgatgattatactttgatagtagaaatacgcttttcagtcatcgataaccctgatgatattgagcagataaaactacaactggcttccagtaatagagtataatgcttcacgtataaacgtggtataatgaatctaagtccatccaataacaattgaatagagaacaatatgagattagaagatcttcaagaagaattgaagaaagatgtatttatagattcgactaaattacagtatgaagcagctaataatgtgatgttatatagtaaatggcttaataagcattcaagtattaaaaaggaaatgcttagaattgatgcacagaaaaaagttgctcttaaagctaaattagactactactcgggacgaggagatggtgatgaatttagtatggatcgttacgagaaatcagaaatgaagacagttctatcagctgataaggatgttttaaaggttgatacctcgttacagtattgggggattttattagatttctgtagcggagctcttgatgctattaaatcacgtggatttgctattaagcatattcaagacatgcgagcatttgaggctggaaaataatgagatatagcattgatgatgcttttaattatgaagaagaatttgaaacggaaattcaattcttaatgaaaaagcataatcttaagcgtcaggatattcgtatcttggccgaccacccgtgcggtgaagatgttctttatattaaaggaaaatttgccggatatcttgatgaatatttttattctaaagatatgggcattgatatgcatatgagagttgtataaatagatatataattcagaggagacaatcatgtcagataagatttgtgttgtctgtaaaactccaatcgattctgcattggttgttgaaacagacaaaggtcctgtacatcctgggccttgctataattacattaaagaactaccagtttcagaaagttcggaagaacaattaaatgaaacgcaacttttgctatagtgtgacctttagtctatagttttggcccttcctttttggttgggccttttttaatttaaaagctttcttctacttcatcgtctgaatcttctaattcagctctttttcctgccaaagcatctctgactgagatgtcatcagtatcttttaattcagtttctttaactcttttcttataataagcttcaagttcttctaaaccttctaatgtttgacaagaggcaattttacccataaattcatcaatagaagcttcataaagaaattgtttaaattctagtaacatctttttctccaaagggccgaagcccttataaattaactgttttcattacgtaattaaatttttcatctgcgtagcgctgaatacgatcaatgccgtgttttaaaagatagttcaagtgaacatatttctttttagtattagcagattttggcttgacaccacagtcatctatgaggtcccagactgttgcgattgttttagaaccatgtttacgtaatacgcgacctattgtttgcaatacaataattttagatttaacaccgtgtgctaaaacaacgtgatgcagatttttaactgaaataccagtagaaaatacaccataactagctactataattattcctttaccgttttcagctaaggttttcattatattgcgggtttcggtatcaacttcccctgatacgtaataaactttatcgtattcatttttaattaaatcgaaaatagctttaccgtgcgatacgtgtttaaacatgacaaaagcgttttcatctttttgtgcaagcttaatagctaatttagcgatccatttatttcttttactaagcccagtaataatttttatttcttcttggtaagtttttccctttaatttagtagtgaactcatcgggatagcgaagaaaaatactattaatttttaactcagttacttgtccatcttccattaatttagaggtcgttactggcttaaatatttcaccgaacattccaacatactgcatgatattggctttgccatcacgtaatgaaccagacaaaccgaatttgaacatgcagttatttaaacctgatatgatagatgaaatactttttcctgtagcaagatgacattcatcattcatcatcattccaaactgtgagaaccattctttcggttgttttactacagtttgccatgtaccaacaacgaccggtgcatcatttttatatttatcatcttttgatgctccaccaccgattttctttatcattgcatgactgaataaacgatagtcaacaaagtcatcagccatctgagttgtcagagcagttgttggaacaataataagaattttgccttcataattttccaaataataccgagcaagcaaagcttgaattaaagatttacctgcggatgttggaagattaagaattctacgacgattaactaatccttcgaacactgcatctttttgataccaatgcggttcaattcttttatttcctgaatagatttctaatttagaaagccattcatcaaaatcttttcttgataattcttctttttcgttaatctgtgggtcaatccaggctttatagccaaagttatcgcagaactttttaatttgcccgactaaaccgaatggaagaaggcgattataatctaaaagacgaattcgtccatcccagtggccatatttgtacttcggattaaaacgatacccatcagcttcaaagctaaagaaatcacggagttcatgaaatgtactttcttcgcaatcaattctcacgtgactaaaatcataaaaatgtactttaatgtcagtcatgtctaaataccatgtaataaatatatctatatttatactgaggaaatattatgatagataaagattatattgcagagctgaaggctcttgatgataataaagaagctaaagctaaattagctgaatatgctgaacagtttggtataaaggtcaaaaagaataaatcttttgataatatcgttaatgatattgaagaagctctccagaagctcgctagtgaacctatgccagagactgatgggttatctattaaagacttaattgatgctgctgatgccgcagacggattaaaatatgacgatgaagaagtcaatccagaggcagcacttctgattgattctccggttaaatctgacattaaaattgaagtagtagaaacggataaaattcctgaaaataccactgttttaattgaagataatccttttgttgaagaaaaattcgaacaggctgtagctgagattattgaatctgaaaagccgtctgtatttactcttccggaaaactttagtccgaatcttcagctgattggaaaaaatccaggattctgcactgttccttggtggatttatcaatggattgctgaaaccccagattggaaatctcacccaactagttttgaacatgcgtcggcacaccaaactttatttagcttaatttactacattaatcgtgacggatcagttctaattcgtgaaacacgtaattcttctttcgtaacattaaaataaggataacttatggcttttacagttgatataactcctaaaacacctactggagttatagatcagactcagcagtttactgctacacccagtggtcaaactggagatggacctattacatatgcttggactgtagacgacgctccacaggaagaaacgtcagcaacttttagttatgtactaaaaggacctgccggtcaaaagactattaaagtagttgcaaccaatcaagttgcagaatctgaacctgaaacagcagaaattagtacaactatcacagttcaaaataagacacaaacaactactttagctgtaactcctggtagccctgatgctggagtgattggaactccaattgaatttaccgctgccttagcttcacagccatcaggtgcaaacgctacgtatcaatggcacgttgacggttctcctgtagacgaagcaactgacgctacattcaattacactcctgacacaagcggagttaaaaaaatcaagtgtgtagctcaagtaactgcggcagattatgacgcaaaaacagttacttctaatgaagtatcattgactgttaataagaagacacagacaactacgttagccgtaactcctgctaatcctgctgccggagtaattggaacagccgttgaatttactgctgccttagcttctcaacctgatggggcatctgctacgtatcagtggtatgttgacggttctctggtcgatggagaaactactactacatttaactatactcctaccacagttggagctaaaacagttaagtgtgtagcgcaagtaactgcagaaaattacaatgaaaaggaagttacttctaatgaagtatcattaacagttaataagaaaacaatgaatccacaggttacattgactcctccttctattaacgttcagcaagatgcttcggctacatttacggctaatgttacgggtgctccagaagaagcacaaattacttactcatggaagaaagattcttctcctgtagaagggtcaactaacgtatatactgtcgatacctcatctgttggaagtcaaactattgaagttactgctgtcgttactgcaactgattacgatagcaaaactattacagcagaaggtcaagttcaggtaactgataaagttgctccagaaccagaaggtgaattgccttatgttcatcctcttccacatcgtacttcagcttatatctggtgcggttggtgggttatggatgaaatccaaaaaatgaccgaagaaggtaaagattggaaaactgaagatccagacagtaaatactacctgcatcgttacactcttcagaagatgatgaaagactatccagaagttgatgttcaagaatcacgcaatggatacatcattcataaaactgctttagaaactggtatcatctatacctatccataatcataatcataaggggcttcggcccctttcttcattttgaaagcacacaaaacatactcagaaaatgatgtatataatggcatcaactcgataacatgagattgattatgagaactgaggttgtggtgtttactcttcatgagtctggaaagtcattcattgaaattgctcgtgaattaaacttacaggcgaaagaagtggctgtattatgggctcgagctatgactgctaagaataaatttgaaactcgagaaaaagttgtctatagaaaaagacatattaataaaaggtgaaaaatggaacagtatgatctttatgaaaatgaatcttttgctaatcgattacgcgaaaaagcacttaaaagtaaacagtttaagctagagtgttttattaaagatttttcggaacttgctaataaagcagctgaacaaggtaaaacatattttagttattattgtactgctcgcgataaattgattactgaagaaattggtgattggctgagaaaagaaggatttagctttaaagtcaatagtgatcagcgtgatggtgattggttagaaattacattttgaggattaattatgtttaaaaagtatagcagtcttgaaaatcattacaactctaaatttattgaaaaactttatagcttgggattgactggtggggagtgggtagctcgtgaaaagattcacggcacaaatttctcattgattattgagcgtgataaagtaacttgcgctaaacgcactggtcctattcttcctgctgaagatttctttgggtatgaaattattttgaagaattactctgattccattaaagcagtacaagatattatggaaacttcagcggttgtatcttatcaagtttttggcgaattcgctggacctggcattcagaagaatgtcgattatggcgataaagatttttatgtatttgacattattgttactacagaaagtggtgatgtgacttatgtcgatgattatatgatggaatcattctgcaatacatttaaatttaaaatggctccacttttaggtcgcggtaaatttgaagaacttattaaattgccaaatgatttagattctgtcgtccaggattataattttacggtagaccatgctggattagttgatgcaaataaatgcgtttggaatgctgaagtaaaaggcgaagtatttaccgctgaaggatatgtattgaaaccttgttatccttcttggatgcctaatggcaatcgcgtagctatcaaatgcaagaactctaaatttagtgaaaagaaaaagtctgataagcctattaaagctaaagttgaactgtcagaagctgataacaaattggttggaattttagcttgttacgttacactgaaccgagtaaataacgttatttctaaaattggtgaaattggtccaaaagattttggaaaggtgatggggctaactgttcaagatattttggaagaaacttctcgtgaaggtattactctaactcaagcggataatccttctttgattaagaaggaattagttaaaatggtacaagatgtacttcgtccggcttggattgaattggtaagttaaataaaaagggacctttcggtccctttgttttattcatcaatgataatttttggtagcttaacacctaataaaacagacaaatctgaacgacccgccattttatccatatctccaccatcaattactcttgcttctttttcatcttttgctacagtgtaaggatttgcagataaagcatatctaactaataaaccgatagatggctgcaaactttctggatcaactacaactttaaatgcacctacatgttcagggtcatctaagtcaagaccttctgtatacggagcatagaaaattgatccaacaatttctttttcaccaatattttctactacgccaacgattacataatctaatggactgttggtatcgcaataaagcggtaaaccattagctaagaacccgtaggcattttgtgaaagatatttgtcatcttctggtttatgttttaaccaacctgatgcagcaagaatcgcagcggcacgagctgaagcaacacagaacgttgctgtataagttgattctttctggatatgtgaaaccatttcacacaccattcggtataatgaacgaccagcttcaggtgcagatgcataactcaaatcaatgaatccagtatcagtaattcctgtaactttatagcgttttgatactgtaatcaaagactgcagaatatctttattgatttcatccgccatttcagttgcaagcaaatcttccaagaaattaggagcatcgaatccgtttgcttctaaatcttgtgctaattcaactgtgatgccagttttaagtttacgagatttaactgcggtttgccatttattaatctggaatctagcatccgcaatttcgctatcagagttttcaaatttgcttgttactgcagcatcagaaaatagacgaacctttaaaagaacgattgcaatctgaagagctaattctaaatcgctttcttcaatatcagcaaatggtgtatcttctaatactttataaacgatattattatatttgaataaatcgcctttattgagagttaatttagactcttctgttaattctgtgatttgttctcggtctacatacccagcttcgccagcgtaagtagcaccagttttaaatgtaaattcgttatccgggttaaggtatttgataccataaaaagcagcaacaggttgattagttctttgcgttgctacaatgtcagaatatattaatttagtggtagcgcgagtcaaagcaacgagatttgggcgaccgattgagttgctattcgttgtggttgattcgcgcagaagttcgttgattttagccattgcgctttcctttcagtttatatgatttatttataccataaaaacaactaaagggacccgaaggtcccttaaatcgtcaaagattagatacctttaacatatacacggcggaagtaagcgtttttaccaaggctattcagaatagaaggcataccgctctggatgcgagaagccggagcctgagcagcggattctgcaaatgggttgataccgataccgtaacgagttttgaatcccattaccggttggaagttcttcggatcagaaccacgcagcggagtcagagctacatatggagcatagtaaataccagcatccatttcgttcggacctttataacctacggtgaaataatcctgtttagcatactggtcgatatatacacggtatttaccacccagaacaccagcaaatactgacttggtagtatcagtgttaaagccagtagccagaccttgtgcagcataagaaatgccggtatcaactgaagccagaacgttaactacgttacgggaagcgataatgaagttaccttcgccgcgaccagtctgacgagcaatttcaactgcttctttgtcaatctggaacaacagagctttaaaggattcacctgcccagcgagcaccacgaatatcgattgggtcctggaagtcaaatacaccagctttagaacccggagtcagggtcataccagatttaccaacctgagcggagtagttaatccaatcaacaacttcgcggttgatttccagcataatttcggtagccagaataccagacagttcagcatcagcatccataccgtgaacagcgcgaaggtcttgtgctaattcaatagagtaagcagctttcagctgacgagatttagcttcgataacttgcttatcgatacggaagcccatttcattccatgggttatcggtagaaccgttaaaaccttcctgaagttcagcgatagaagtagccataccttcagcgatttctaccagtacaccagcttccatttgtttcttaatttcagcatctaatttgtctgcgtcagatgcgcctgaatcaatttgtttaacttctgtagcttgcagatatactgtaccagtttcctggaagaagtgagtgtaaatagttccgacttcaagagtatcacttgctttcaaagcagcgaatttcttagcagcaccctgaccagagaacattgcatctggaccatacattgggtggaatgcttctttagcaccggaagcgattgggtctttaccatatactgcgcgcagtgcgaatacctggccagtcgggctgttcattggctgaacaccacaaatatcgaaagcaatcaggttaggaatagcacgacgtaccatacccataacagctgggccaatctgagttactgctccagaagtctgacctgcagcgatgttggtagcattgtaaccgtggtcaccaccgatttcagcttctgttaagaaagaaccgaatgcctgagcaattttttcgtctttatattccggagctgtctggaaatctttttcctggttttcaaagattttagcgataatcgcttgtttgctattagcaatttccggtaaaccttcaccttccagtaatggcttccatttgttcaaaagttcagctttagttttgatagtcatttgtgttaacctttaaaattagaaacgagatgcgactttcgcatatacacttacaatatcttctgcaccttgtgcagatttatcttctacagcttcagtgacgaaattcagtccggctgcttcagtatcaggagtatttatactctcagtaatagtgctttcatctttattagatttcttcaccatttctacgattgcactcaatttacttgagaatgcatctgaataatccataccttcgaccagagcagagactttttctttttgagactcagtcagatctttagtactttcgctcaatgccacttcacgctgcacataattgatatatgcgtcacgcttattgagttcttcgaacagacgagctgattcttctttatgttcttgcagttcttcttccatttcagctacaacatcaactgattcttctggaacaacaacgttgtgttcaacgaagagctctttcaatccaccaagcatggattcaaacagttcggctttgatacctttatctactgctaatttattttcagtgagccattcttttgcaagatggtcaaggaatttagaagcttgctcagcgattttcttctcagctttttcttctgcttcttctttatttttttctacttcttcttctgctttttcagcaattttagcgatatgagattcagctaatttaacggcgtgctgcttgacggtagcttcgaatacagtgccgaaagtttcttttgcttccggagaaatattaactgattcgaaaatactatcaagagcaacggaagcatcaattttttgcgcttcagcaatcagttgttctttaagcattttgtagtcctgttgtttagataataatatttataacgcttttttcatggcctctgcgagagccatataggcgtcatcggcacttgtatcggcttccgccgtctgtgattcggtaatttccttaggagttacccatgcatctggagcacttggaccccatactgcatcaacacctacagttaatttgaatccttcgtttacgatacgataacctttatttgtgtcagtcaatgaacctaatccacgagaagaaactcctggaatccatccggcacgaatattagctgctaatttatctccaggaccgtggtcaccttcaataacacgagctcgtccgtatacgtcatttcctttccaccacatatcttctataatgatagcggcttgcatcgggtcaacattagcgcgtggaggatgatttaattctccgagagcttgtttagttaaaacttgctcattaatatagtcttttaccgctttttctaatatacgttttggataaagacgtttatttctattgacgacttccgcttgcatgaatattccttcgatgtataaacccggttttaaacctaagtcttttccatcatgagattcaagcattggtacgccatcaataatttcgccaggttgaccccaagtttcaattagtaattggggttcattcattagcttaatcctaatgctttacggcgtttaagagcttttttacgcttacgctgagcacgagattgacctgctggattggcaatcttcgttttggtagctttacgagcaatttgtctacgttttgctttagacaacccggtagtttgaaatgcattacgttcgcgggttttgcgatctttagtgcgagtaatttcaccacgggcagaaacatgtttaacgataaattcatttaacggcatattttcattaatagaagctaatgcaaccgctaaatcagtttcatcatcaagcatattctcgacaattgtatttatatcgtctttatttaaagcagaagacaattcgtcaaagcgaccctgtgcttcaggaataagtgcttcgacattctcgagaactaattcatgagtttcagggatcagaagcattattcatcatcctcgtcttcgtcagagtctttgtcttttttgtcgtctttatcatcactatcttcgtcttcgtcatcatcctcgtcatcaggttcttcaccttcgattaagaaattacgagcgatagcgattttttcttctttaattaaatcagtcgttcttgcagccatggcttcagcaaataatttacgagcggctacgaggtcgtttgatttaatagcttcaattaaaccttccattaaaaatcctcttgttcttggtcggggtcttggaaacgagcctctttagactcttcttcaatttgcttggcttcttgttctatttcttcatcagtcatctgcaaaatatctttcatagcagttctgtgagaaatatatttaccaataaatggttctgccatggttagcatattaattcttcgttccaaaatttctgcttctttgagctcagcaaagtagctatcccgatgaaattctatcttaatattatttatttcatcattccactcatcttctgtgattatacctttaagcaaaagatttgttttaagtggatctaggaaaacttcttcaaacttgtgctgtaactcacgaataaatttagcaaacgttaattcatcacgtgtaatgctagttccagaatcaaacatcacaccgccttgttggtcttgtggaatgcgtgaaagaggaacacgtaatgccatgtaaagagcttgtctaaaccaacgaatatcttccatattgccagtattatcagcaccaggaagagtatcaacttctgtcacagctttaccatcacggcgctgcaaccaatagtcttcggtcatagacatattatgttgttgattttttattttacctgttgatgcatcatatactacacggtttttcatcgtgttcataacatgttgcatgtgctcagcagctttacgagcaggcatattacctgtgtctacataccaaacacgacggtcaggagcacgagtaatgcgataaatgactacagcatcttctaataattttaattggttagcaggtttaacagcacgatgtaaatacccgatgatatttttgccacagcaatcgactaatccagaatgggcataaacaacagcagcttttggaatttttatttttgtgccagcttcatacattctaccatcacatgcatatgactcatgggcagtatcatatataaaatattctttgtaacctttaactatttttgtgccagcttcagtttctgttataatttcgcgaacatactgaacttggcgagggtctaatctacgtaattcttttatgccttcttttggacgttttggatcaatgattttatgaaagaaaattcttgaatcaacataccaacgtctaaaatgatcagaaccttttcgttgaaacgatagatgatttaatacatcactaaattcatctaacatcatatttttaatttttggactaaatttagatttatccaaatttaacgctacgacttcagtatcatcttcgtagacgatagcatctgaaacgatttctgaaactgcattatctacttcatagttattcatgagattacgatatgtatcaataagctcacgagtagttttcattcctggttcatatgaaccaaaaattgtttggaatgcagcattataaggagaagcagcttcattcgagcttacttcaaattctcttgctccatcatcaagctttggggctgtaatggaaacaagatcttctttttcttggtctttaaaatttcgttcgtccattttagcccatggagcaaacaaacttaatacattaaatttcattgtattctccaaatgggaattatagttatatttataatggacttctctgctttaagcaggatggggatttctccccattcattttattcccaataatcgagagcaagagttacttcaaaggtttggatttcattgtttgaatcccaatctaattgaagttcacccacgttagtaggccacagacctttaatttcaatttcttttgttactgttttagcatcacgagcatattgacgaacaatagcgctctttttatactctgcaggttttccaccagtaatttcgtttccttgaccagcagcaatgctttgccaatcaacaaacttctggcgagcatcatgagcttcatcgttcattactgtaacagtccagtcatcgaatgtacgatcgcctgctacgttaattttacggttcataaatccgactggaattttttctacaataccagctggtaaagcagtggctttacattggaatgtaaaattttgtccaagataagaaatttctacttggaataagttaggtcgagcaaaatcaccagattcaaacgctcgtgttacatcatctacaaacatattagcctctgtagtatttatatccctatgtttaacctagggcatatagaattaaagaattaaggatatagtgtatttatatggcctgccgaaacaggcctttagaatcattctagtaaatcccaaagatctacactatttctttttgatttttctcggttagattcccaagtgattatttctaaattattaataccgccaattattttagcaggaattaaattatcaaaaccgtatttgatagataccttatgatcaagttggtaagcgccttttgtaccacacactcctattttatcagcatttggccattttgaccaaattttcttatgcttacgagtttctttatataccgatgaaatatattcacgcatttcagatttatttgggttccatcttggatgatttacgccatgcatacattctactgtttttcctttattcgcggaaccatatgaattattgcgcattttatctttatgacggcaatcacgacaaatatcagtgtttcttccaatgcgttggttatattcaattccacatttatcgcaacggcattttacatacgcggtactacctttaatgtcttcaactttaacatcaatttcataatacctaaatccatgtttaaccgctccaagaggtgttaatttataaccctttgattgataatgtttaaaatttgatggtacaattttcactttaataaatttagaaataatcacttgattcctcgagaataggggccgaagccccatatcaattaacctgcaagaccagttaactcatcgaaatctgcaccagtagcagttgcgacgaaattcaaagtaatataatttatactgcgcgccggttgaatgtagaatgttgcaacaaactcatttctatcaattactgacggagtgttatttgttgtatcgcaaactacacgatattcataaattccaccgagagctttaattccctgtaagtactgggcagtttctgtgcggaatgatgaacgagtaaacgcgttgtttaattcgaacaaacgatattttgaactacgtccgatattcgttttcaacatattaaacagacgacgaacgttaatacgatcaaatggagaaggaacagaagtagctgttttatcaccatacaatacgtaaccatcaccacctgtaccagttactgggttgatagcttcttgatataaacggtcgcgctgagcttggcgagtttcaatagcaagtttaataacgttaagaatctgaccacgattataaccagctggagacatccaagtctgagaaacgttatcagttctcgcgcataaaccagcaatgtcagctgctaatggaacccaacgatttacatcattatatttgtcatactgatatttgtagttaccatcaattgctgcgtaggttgaactaatattaaagttattatcagtatatgaacctgccgcagttctccagttaactaaattatctactgcacgagttacaggaattccaacaacagtttcacgcggtggtgagcacaatactaagcaatcttggcgagcatctccaattgaaacgacgtgtttttggacagtagatgctgtttctaaagattcaccggcacaagaacccgcaataaacagttgaacgtcaacagattcacggtcagcaaagaagtcccaagcttccatcaaatctcctgctgtaacttcagcatttgatgataatccaccagaaagagttaaaattccagagaatccttctggccagttttgtgcagttgcaaaaatatattctgaaccaccttttgcgaaaaagtcatcgatatagatgttactatcgtaaatatctttttcaccacgcttagttgaaagaacaacgctttgaacaatagcatcatttcgacgaactataatagcgtactgtgagtcagtctgcggcccatatccaaatactgccttggcagtagatgcacgagtaccaccacctggataaattggcagtaatgcagaagcgcctttcgcatagtcagctttagatacgatttcaatttcaattttatcgcctaattcgcctggatagagagctactactcctggaattccatatttttcaagatttgcctgaaaatcaactgctgtcatagcagtttcagcgctctcgatttcagctaataaaataccggaatcagtaataatttttccaagagttattactgcagctaaaccggaagaagatgaagaaatttctgcagtccagttagaacctaatgttgggtattcgccaacttctttagctttagcaataatttttgcagtaggaatattaattttcttaatttttccatcagcatctacttcggtaattttaccttctgtttcaacatcttctgaaacatatttgaccgtgattttatctccaaccgcgtagttactacctggggtagaaattgtgtattcaatattaccagcaatcggagatgagtttttagcggtatctctatcgacagcgcgcacaactcgcaaatcatttccatattgtaagaaattcattgcagacataaaatagtcagcagtttcagctgtaggttgaccaaaagtattaactaaatctacttcgtttgtaacctgtttaatctgaaaagcaggaccccactggaatttaccggccaaagctgctgtaccagtagagttattaaccacggtgctttgaaccgtagtttctttgagctcaatgcccggagataataaagtcatttttaatcctctttaatatgctttaatatatttataccattgacataccatgagatactggaacatactcagcagaatgaaccgaatcaacaaatataactggagcgtattcatcccccatatcttgaagctcttttgaaaacacttcagatgctaatcgcatgtcatctttgtcggcataatcaataaattttgattgtgttgataaccatccaaaaattactaaagacattactaaatcgtcatgataaccttcttcagccgcccaagacacgcctttttcactaaacgttctaaattcttgaatagttgcacggtgatgaataataagcttatctttttcaataaggtcttttaatgtagagcatccgactgctttcgttcgtttagtttgcttcattcctaaatcagtatatgaatcgcaaataacgccttcgtattctaaatccatataaagtgatttagcaactgacacaccagtactatttaattcaatataaactgggcattcattatattctactaaataacgcataacgatgtcaggtagaattaaatgagaaatagtgtttgagtgtaaaacaccaacttgttcccacacatcatcggtaacatcaataatatgtaaagcgtggtaatcttgcccacgaccttctgagcagtctagagttgcaatatattttctatctggttcagggcttttaaatcgatgaaaaccgtgatcatctggagttacttcaatgaaatccataacagctaatttcattcctgaaattaatgtaccggaagtcccttcaaatgctgcggtgtgttcttgacgaaattgagctaaagtagaaccattaatggtttgtatactccattgccatccatcgtcaaaaatatcttcatcattataaagacgttctttaactgaattccaaatagcagtgtatggttcaaatcctgatttaccttcaacagcagcagtccaaatatcataaaaatgatttaatccattaggagtcgtagtaataataatttttgaacgacgaccagatgaaataactggttgaatagcaagccaggaatcatggaagtttggaataaatgcgcattcgtcaatataaatcattgcgaacgagttaccacgaactgcgtctggagaggaagcataggctccgattgaggaaccattatcaagttcaatagaccctttattccattcaacaattcctggctgtaaaaagtcaggaagcagttcaattgcttgcttagtacgatctaaaacttccgcagacattgaacctttgtgcgcaagaatacctacagctttatccttgttaaaacatacaaagtgtgcaagaaaaatagctactacagttgttttaccaagctgacgtgatagattacaaacagtcatacgtttagatgacattattttgagcatatcacgctgatagtcacgtaattgaacctttatgacaccatagtcgatatgagtaatggcgcagtatgtttctgcaaaatatacaatatcatctcggcattttttccattcctcaaccatttcacgagtccattgtgttttaatattagctcgttttaagttaggaagacccatataccgagatcttttattattcttatctttataagtttgaaataattcaggcttatcagaattatttgggatttttactattttgtgtaaacgaagataatcactgaatttttcaggataccattttccatcccactgtgattttatccaatgaattccatcttcatcttttctttctgctaagcttgggtgttttattaaaatttttccagcttcatttaatggatggaaatcatttaatgcattaatcggttgttccatttatcaccttctcacgagcttcttgagcctcgtaagcatcaccaatttcgtccattaattctgttggtgaacccatgaatactgtcgcgttctgaatattcatttgacctgtaggaacagcgcctttagtgccaacctgctcagatgtaatatctttcatatctttatgaagcttcagtatttctctgttcgtcgtagtcatttgccccataagagttgcaaatacttccatgtgacgaggagaatcagcattctttgctgtctcaagaaaaatcttggccgcgtccattagcatttgttgttgaaaatgcatatttcgacgaactactccataatcatcttctaaatcaggagtacggttttgaggattgcttttaacttctactaattgcagaggttcatatactttaatttcctccccgtcgattccggggaggtcagaaatatctaaaagtttgtttatatcaagaccttccataataacctctatgttcttgggccaggaggttctggcggtgttggtctatttacattgctagtgaaagtttgttttactgttccatcccagtcctctgggttaatatctcgaggaacaacttcgctatcaacagattcaaaaacaccttcgccatcaggcaaatctcttgtattggcgtgaaaatctgtataagtagtacgaattaatccttctgcatcatctactggaggatacatccatccgtttacttcaaatgttagtgaccattcgattctacgacgagataaattatctccatctatagcttcatctatagcagcagacatcagtacaattttaatatcccttttaaatggaatatcatttccaaactgttcgtacatagttgtattaaaatgaggttgaaaatatggaagaatctgttcaactatttgaaacatatcgtcttcgtaacgagtaaagatactcaattcataaatcattttaataggagatggattatactgtgatactacagaagttgcgcctttttgcagtaaattctgatttaaaatgtttgttttaaatggagcattatagctaaaatcaactaaatgcaaatttatacgaggtagaatagtttcaaccttggccacatcttcttgtgaatttatcgatgtccatttattcaatttcatcataaagtgttcctttgatgcatacgtaataggaacacgtataaacttatcaccagattctaactgacgtttgatttggatatttgaaaacaaatcgcccatcaaggtagcatatcgtctaaaagacgaattataaaaataaccaaacatgatttctcctaatctgggctttaattagtttataatatttattaatccatgaaatcattatcaaatgggctagattcgaaagatttgcctctgttattgacaacaacataaggttcaacatattctttagcttcagaattaatttgatctacttcagcatactgatcaatattaatgtcatgaataccgttaagattgcgaacaggatttaattctaattcactaaattctggaatgttaattccttcatttttctgtagaactggattaatttcttctccagaataaatgaatttacctgctgtaattttacgaatagcgttttggcctaattgataaaatggatcatatggttcaacccagttaatttcaaataagctgttatccataggaaaatatatcaaatcgccttctttcggttcttttccattaacttggtgtttaaacaagtttggattaatggacaaagtaacttcatcctgtacttgcataccaaagttactaaagaacgatttagctccttcatatccttcaaatgaatttaaatatgcagcgaatttccaagctttagtaaatttattttttaagtcttcgccaaatatcaaatcaggggaaacatactctcttggaacataatagcattctacacctcgcatttgaatgctttcagctactaatacatcagctaatatttgactgtttttataatgattgaaatttacataaggatttagtatttcagtttcattggtctgagaataaccagtgcggttttccaatttagcaaaaagatttttatcataagtagccatattaacctaccaaaattccaaatggaggatcgagcaagtataattcttcacgtaatgcttctttttctaatcgagcttcttctattaagcgttgtccatcaatcgtaacaccgccaggaagcatcataccttgatgacgtgctaaaatttgaccattcaattctttagctaaagctgtagcatagtctttcacccaacgattattataagcaccctgtttaacattcggatcttgaccaacaactcgaccaactaaattgtggtctgggttattatatcgttcagataatgaccagctatcttgtggaccgactgttccatatcctactgtatttccaaccattttattagtattaatgtatgatttagtccagctttctacgataattaaatcatatttttggaagtttcccatgactttgagctgttcatttgctgaattaaaccaaaagtctggaataggagagagcatatcttgcatcattcccatataactggtaagttgagtaaaatatcctaaatcagctccaaaggcatttggtccataaaatctattacaagaagtccccataccgccattaataccagccattcctaaaagaaaatcagtaaaccatggatatgtagcgtttccgtccattgacgttattgatccaatatttgttcgcaaaatgcgagttactgcgaatacatttgaacctcttaaatcgaagactccggttttatatttttcttcgtcatctcctacataaaatacatgaaaacctttgttaagtccatcaaaatggtattcaccgtataattctagggcacgctggatgcaatcataaatttgatcgggtgttaactcaacattgataattggagcccctaaacgtcttagaatgacatctttgagttcctttggattctgagaattatatcctgacatttaaaatcctttggggccctgcggccccatgttatgctggtgataaaaaggtagaaagtagtacccattcgccgtctttacgaacgtaagcttggccatcttttggagcttcaggaatataacctgcttcttgtagagcttgaacgctgctctgtaaagaggatatattgtctttagctgtatttacttcatgcgtgactaccgcaatgttagtttcattcgtttttatagaattagttaatcctcgttcttcaacagttgatccgtcaggattatttccatttataagtgaagtaagttcaataacttgacctttaattcctgttctattatttcctatttcaacttgtatattttgaacattattgtttaaaactgaaacttctccttcaagcactgaaactttatttaatagagatccagaaggagacggttgtcctccgctggagtcagttccaacaatttgatttaaccacgaaacattcgctcttaaaccagacgaagtgttttcaccaacaattccgtttaaagactcaatagaagttgtgtgatttttaatttttcctttaatactagaaggaatatcatctgaacctatagaagtttcaatagccgttaagcgctgtttaacaccttcactctgatttaattcattattaatagcttcaatgctacttttgttattattaatttctgttattatagaaacattttctgggtatccaatagaagatttaatttctgctatatcagaaattattaaagtttgtttatcatctatggtgtttaatctattataaatatttggcccaaaatctactggtttattaccaagttcatcacgtaatttaccaacttcaacagttaatgatcctacgtcagattcagtaaatttattttctaattcacttaaacgaatgccttgtgaagataataatgtactatttgttattattctgtgtttcattcctgtgctagcattaccaacaacaggaagaccgttaatgtcttggccagaatattgtcctaattcctgtttaatccacaataaatcatttctaattgttctataaacagagttttcttcatcattaaatggacctatatcagcaataattttgtcaactgtattattagttccagttaatatatcagtgtgttcactggtaagtgtctttaaattcgatatgtcatttttattaacactgatctgcgatagtgcttctatatctcctgatacatctaaaactccttgaattgttttaatatctttctgtgatgtttcaatggcagttttaagaattcccacattttcatcaagaacttcgacgtttttaaacacggaaacaattggtctattcattgatccatcatttccatacttagtactagctcctaatatttcttcaccatttttaatccatgaaatacgttcctgaccttcgtcaggaacgctatcaacaaaaggtaactcttttaattcaatcatttgtaatccttagtaatgaactttaataatatagtttaatgatatattccatggtctagtttcataaccaattaatccttcacgattaagtgtaccatgagcatctctcggtccacctaattcaaatccatcattagtgaagtatgaagcattatcccagtcggaatgtcttctagttccaagatatccttgataaactgacgcgccaaatgggccttcacttctgttatattcaccccaaccaccagcatgtttatggtatgacatttgttgtgcctgaacaccaccaacatgcattccgtcacatcctacgcccagtctatcctttccatagccatcttgtccacgttgatttaaaatatgaccgcctgtgccggctcctctgacgaaaagaccccgcatatcaggaacgccaggattattccaatcgccaccaaatcttgttccaactacgtttctataatcaggaaattggtcacctgacacggttccaccatgacacataatccaacctggaggtgctgaatcacccgcaaacatcataatagttccaaccggaactcgttcggacgcatatctttcagtggcaacaggttgatcgccatttttccacattccaccgcgtgaccaaattccatttgctgtaagatggtctaaatttaaagaaccattaatagtttgtccaccacgagtattaattacatctgcgttccatgctaatgctccagagctatcaccttcaggggcaataccggcttgcgtcgttaatttaactactccacgcatagaaccggtagctcctcgaccatttagtgtttcacctgttactgcaacaccacccaaattattattaatttcagtctgcgttcctaggcgtataacacccttatattcatgtgttgcaacagaattcataaaggtatacggggaaattgcatatccttcgcggagagttccttgacgaatttgtgcaacagtagataattgaactactcctctcaccgattctgttgcagtgtcttctgaaggagctatttgcgaaattaattttattgcaagtttttgggtttttagcggagtcatcgcagtagtatcatcaactccagccaaagctgcaggtgtagatgatattttaataaccccgtttgatgactcagacgaatatctatttttgaacacatcgtcagtgtggtatttcagtttttgtggtgttattgatgaattattatctgagccttttaatgtttcttcatttgttgaataacgcgttaaaccatatttagtttcagtagcatttggatacaataatcttgttgctaatgtagctggtgtaacgattttagaattattagttccatctaaaacctcttgctctgacgcaatcattgctattcctttaacttccatagttgcatcaggaataccatttacgccgatattacttatttttgataatgcagactgtactgtcgtaacagtgccaggaaaattcgatccagtaggatcgaatttaacatattttgattcatttgatacgtgctgatatgtattgttactcatgctactctctcaaaataataaaatactgtaggttgtgtgtgactatctagcgtaacagtttgcgcacctaataattgccaagttccatacccaggtttagaaggagaaattatttcctgtttgaaagtaattcctttatcagagtattgttctaagatatgttcttggttatctaaatacttaacttgtattttatttcctatggtaggatggtcttcaaatgaatcaattgcaataaattttacaaccatttcctgtagagctattctaacggcactagtaaattcaattgaagtcattccattagtagctttaactggaataccaaacatgttaacaataactgggtcacctgatttgactgaagtatcagtaacagttccttcaaatgaccaatagtcggtttgttgcacgccagtaggagatacgccgcttatattaactaatacagctccaaccggttgctctgccatatttctaacatcattgatagcagattctacattcgggtcataaaaaccttttgctatttgtgaaattgttacagcgcctactggctgattattcataaccgaaatatcatttttcttagttctaaaaccaagaaaatctgctaagcgggaaataactcccgctttattattaagtaaactcattatgcaatccttatccaacggtatacagtaatagacggttgaatattactaatattagtaggaggagtatgtgaagagtttgttgttgcgtagtcttcacgatattttgtatatataggaccagtttcgtctgggtcatattgacaacctccaataataactgatccgttttcatcttcaattaaaactttttcatcagttttagtcgcaggaagatttgcgttctcaagtgtcaccgatgttgttccaactgttccaccggcagtatgtgaaggatttccgctagaatctaaatcattattgtttaaagcaaagtttggatccgtaacatcatcattccatcctactaaaacttgtcctttaccaaataatttccatgaaccaaatcccatataagtcaccggattatttggatttatagcattttcataaattgaacctacaggataaatgctatcgaaaatagatgatattgaattatacgttctagtataagaatcaactttttcaacatttggccaaccgattttatcaaaatctgttaaggctacatcaccagtaacttcggtagatgatcctttactaacataacggtcatccgttaattcaatgatgtcatctttttctaaaagagttcctaaatcattattgaaccacgttataacgattatatcacctgattcaaattttctatcaaataaaagactaacaggttttccatcttcatattctatagaataatctgtgttagattctttccattcaccaccaagagatatacatcctgcttgcgtatctgagttagcaccttcacacaaaaacagaggatatcctgctgttccagcttgttgttgtaaaattccattaaaacgaacttcaagagaattaggattaataggttctccaggaattaatccaaatgcagagaatggaattgatttcattgttgataaatcagtaacgtaaatacttccttctaaagaagtttttgacgttaattttgaatctaatacttttatttggcgtcttgtatatgaacttctccattgtgatataccatccataaatgtttcaatttgaacagtgtcaccaatattacaaggctgtcttaacctaatattaaatccatcaagaggaatcaattctccttcattttccccaggagagccaaagtcactgttttcactaaatacatcgccgtaatataattcattaccacggtgttttactcggatgttattaacattatagctagttccgcggaaaacatctaaaaagtctgtttgtccttgaacttcgactaaaaattctttacgtgctacattactaatatctgaactaataattttgtcaatttgtttgtttttgacatattcccaacgtcctggagcacaataaacgagctctaaatcactaaattgaatattaatttcaactgacgatgacgaccctttaattgtatccccagaagcagctactaaagtaactggattaatgttccatgttgcaaatacatccctagctctaattactttattataatcattaacagttcctttaggaagttgtaaagttactcttccagaagaggtattaatagcgtatgattttccccacttagcttttaatgtttgaccggatgaagcattataagttttccaggcaccggctgaatatggaacatctccatcgccaagttcataataaagttcatcaaagttttcatttatttttataccacctttacgcaggtagtcaccggtaccatcatcaacaacattaccgatattaatattttgtttcattattgagccaccccgattttctgcgtagcgataactttaactgctgctctcataccgacagttgaagaacttatagttgccgttacataattttctttaatactaaatgcaatattagcgatttcgtcttcttctgtttcatttccaacccgcatgacagcatattcagaagaaatgaccgctgaattaacagtatctacaagaatatttatttctgccgttttaatttttcttccatctactgattggcatgtaactaacaatttagccatgttatattcagtacgatgaaacaatggaatgtcaactgacccagatgtagaaatattccatgtaccttcggccggtgattccttttgaccaaacatactttcaatagaataattccaaaccgacgtagaattatcagatgaaatacaacgtaaagtaactttactatatggactagttactactaaattacctgaaacgcctttaattgaatcaatagcctgaatcgttaaaggattagtaactgatattgatccattagagttaatgaattcaacacaatcgccaagttctcctctttcaataataactttaacacctacagtagaggtatcaatatcatgtctagtgccaactttcactggagttgcgtactccgcgatagagtgcttttgataatatccagtagcatggataatttgaccatctgctccagtgccatttgctactgccattttacgctgatcgccaaacgcattataaattgcgttaaaatcactattaattttattaccaccgtcgaataagatatcaccagtagaagcgttaccaatttcgccggtatcaatcaatttctttggttcttgaatgaacatagcggtttccttatgagtttatagtatttataaagaaaaagggagcccatgggctcccttaatttaaaatgtaaacagaatattgatttcttctgtctgatccattgccatgataataggtggcctattttccatataaatcatttcgcccgaatgcctcattaaatcttctggatcataataatccttttcagctttaacatttgggtcatttgggtcatttggatgagctttagcttcaagaggatttgtgattattgatatttgtctaaatcctttatttcctggcaatgcagcatcaggaaagtaaactgaatctaaatatgctttaaaacggatagtatttgccttaacccggtaaattaatccaaaatcatcttgttgccaagtgagattatcttcatacccccatctagttgggtcttcttttaattcctcaggccaaggaactacgatatattcatttgtgcatctatttatagatacatcgggcggaatctcaaaaagatattcccaaacatatccgtctccaggttcgattgttccttccgcatctcctcgaccttcaggaggagtcattgacctaacagaaggagtccattttccgcctaatttgaggcattcatccttattagttaaagatgctattgaacacattccggtatcaggaacatctaaacaacgatatactaaccagcctgcgcctgattcagtagcgttgtaaggagctgagttacacactacaatatcgttaattctaaatgtgtatggatccggatatctagtatctccccaatctctgcgaggaataacagcatcaagcattgatggaagaacttttactgttcccatcatatgcgtccacatgtcagttacgcctaatacagaatcggttggataaggtggggcaaagcccacctcattttcatttgatgaccacggttctgatcttccaaatgtgataaagatagtgtttttatccggaccacttccaattgaattataaaaattcagcattttttctgttctaaattttgaagtaactatcgcacgatagataacacttgaatcattcatctattttaacctgtgttggattttcagggtctcttggatttcctatattatcttttagacgtttattaactaaatccctaaattgcgcaaatgttgttccagaagcatcaaataggggactcattaatttacgtcgttcagacggcaattgaccttgaaatattgaattattattttcagcattatagtcatcaggaagaggatattctacaccagccattgggccaggctcataaattgcttcgcctgttactgaatcatactcaatttcaccggttggagttaatttagctactctatcagcatattcagtaggcaatccagaatcccatttatagtttttgtatttattaattatagtctctgtatgtttaagagttaaaccaacattaataaacatcgttaaaagggtaattgctataaatccaaatcctactggatgaacaaaacgaataacgtcagatttccagcgggaagaaggtaaattggatttaattttcattacatagtatgatctacttctattaatatagtctatattgttttgaagcaaatcctttcctttaactccacgaataatttcgccttcaaaactagggagtctttctgctttaacttcttgaccagcaattaatcttcccaaaagattatgaatagttacggtccattgcaatttaccattagaataacttctttctatataagtaacattacatcttcctgtggctgtataaatcgtttgtcctactaaatcttcagtcaaagaatcagattgaacgattatgtcatattcagtaccagccccagattcaatttcaatttcaacttcttcattataaagaactttaaaaagaaatttgtatgatgcttcaattcctttagtagaataaaaatcataactacgtgattcaaaaaatcttgcaacagcatcacgtttgtcagcatttaaataaatgtttcttttatatatctctgaccacaaatattcccacgcatgctcttctcgtggatactgattacgaattaaatttcgtaaattattatactgagttccgtatccgtcagaaagatattgaatatatgcttcacaaaatgcctcaaaattcgaatcctgcaacaaataagaatcaggcatcattgtgccaattaatggtcttaaatcagggtcagctaatccatgctcttcttctggcgaccaaggagtctcatgctcttggttttgtaaaaatgcttttaaaaatactccagtcggcttccaaataatttctactgtatctctcacacgatagttaaaatcataataagaaattatttcaccagaagatttataaaaaagcatcccagacgcatattttttaaatcccgtgaatttaacatttggcattactatcgtacaatcaccatcatcccagtattcatgaactaatctatctggtgatgtttccggaatattttctataactttagtgtattttaaatcagcataaactactacagctctattagagttgtttatccagcaccgtgtattagactttttagaccagttaaagaatggttctgcatagtatttcattggctgaggcgtaaaagtttcccaatcagacttttcatctgctataaatgccatcatatgataatgcttatcagctaaccattcacgaggaaattcatatttaacggcaccgattaactgatattttgctacagtttcagggtcattaacaacgttatcatttaaaaatttaaaattactcgaagatagagaaactaatttaccatcagttgacatattcgcatacccaggttgaatacgtcttctttcttcttcagtgttgccaaaaactcttttccacgtttttgtgtcatgatttaaaacatatattcctttatcagcagaatcaattatttttgacgttctaggattagcatttaatgtttcaacttcaccgataataagagcaaaaactttatcaccaatagaatccattttatagcatactgctttaggatttccagttatagtcattgtatcaggttcaaatagcctttctgaatatgttggagataatggatcagaatctataggtgcattgctcgtttttatatatctaactttatctctggcaacaacatagatataatcatccgtacaagtaatggcttcagctatacgatatacattcgctggtaaagtcgcataagtaccaaagatttctacatcaaatcctaaatgtaactggtcgccaagtttagcaaatgttatatcctgcgaactgaatctgacatcatctgctgaccatctaacgtcagtcgatttacggccatagaaaatcttgtcgtatcctagaacgtatgttgtgttcgcagattggtaatatactgtcttagataaaggatatcctacacggtcattgaagagctttacggctttccaggtttgtcctttatcattggatactttaactacaggttgatagcgctcaaaaagatatagaattccttctgattccatcaaataaactcggttaatatccttacatacttgctgaatagaaccttgtatttcatgatactcattttcaccaataataaaattacttattgatgaaacatcaacatacgatgggctgaattgaaatgattcattcatcaatgcagccattatagtgtcattattaaaattgacataattagaattgttaagagtaaacttttcctgaatgaatttattggctaattgcatttcaatcatgttttgaaatgtgtaagcattcgtagcaaaagtttcaaactcttccgtataaacccaatcagattgctcaaaatcttgtgcagctgtagctactctaatgatgtatgatgttagtggatcagcatcatcaaaaaagaaactattgtttgctgtatatcctaaattaatccaacgatattgatcactcgggagattttcccccgagtctgtttttgtctcagcgatttctacaaaatagtagaaattagcaccaacgtcatcccagcgtacttgcatctgatttgcggataacttggaaattctgagactagtgactgaaggtgcttttactgtcattgtgatataggctccaaatcgatagttaagtattgcggacgtaaatcattttcaaatacaatcagtgaaccatcacgggtaaagataacatcatcggttgggtcagaatataattcaatagtctgaacctcaaatttttcagatgttaaattaattttagcgatattccaataaatcatgtcagccggataatttatttcaccgataacatagtatttgtcgcgtccatcagaatttgctaatttattaaaatcattgcctgtatatggctgaatgttttcattttctgtaacatcgccagaagcaaatggaccaataataactttaccaattcctttagaatctcggtctgttgatactatacgaacatcatataatacatcttcttctaaaccagtatcaggatttacaacctttcgtccagaattaaatgaaaacgtattagattccatagaacgatcttttatttgattattgtatttaatacctgcttcaggtgttttatagaagttttgtacttcacgaaccatttgaatagtcgctgatgaaccaatgacagaatgatctgcatcatctacataagttaacatcttagatttagcgaaagacgagttaaaaatttctacatcttcggtataataacgatcaattttatcaattatttgaccttcgagccactgttcggattcttgcagcttatttaaagcatatgtgacttttaaattagtcttaataaaaagataattaggagaaataattgatggcgtaataggagctaaattatagtctttgagataatttttaatatcttcgcgctgtacagtagttaaatacagacctgatttaggtttagcagcaataaatgcataaccaggtttagtagaatcagtgaaagtctgaactgcttgaataatagaaccaaatctctctgaaacgaatgtatcatagtcagtcgcagttacgcagcgttgctgggtttcgcgtttaatagtacccaattcgcggatacgctcaatatcttctggatcaccgccgccatctgccccaacaaaatctgggtcatcgtttggattttcattaatattgatgacagttatatttgttaatgtatctgcgtatgaaaatccgactgctccgttcgcgtcagcaccattagtactgatgtactcaataacaatcgtagagttctgagtaggtttaagacctccgatataattggcagttaaagctccttcagaagcattaacagaaatttcaccttcaccaaaatagaattcagtgtttccatcaatagtttcacgcatatagtaaatcgttgatgttgaaccagcatgaaccattgactttctcgtccagttaatccattccgctccatcaacatataatttaacctggtttctatcaatatttttatcataaatgataataggtgttaatttatcataaatgatttcagttcttactatacgtccctgggccaattttaaacgcggaaaatattggttatttttatcacgaatagcaataacgtcttcggtagaaacgaagttatatggattaacagaagtatcttttgcatatgctaaaaagcgagttccgcgaggaatagtaatgtaattcctattcaatgcgtcggtgcatgttaacataatttcggtctgcgcagcggattttgaagtaggtaaatatccgttatcttgtgcagcttgaacaactgaacttcgtaagttagcagtacgcataaagctttcatacacagcagcattaccaaactgctgaatgtacaatgtattataagccaaaaggtcacacagaacgtttaatcttgagccttcaaaatcataatccaaaaattcattttggccattaagccattcaatgaggttttgttttatttcagcaaacgtacccccgacgaatatctcgggaatagcatttgctgttcttgttaattgataatttacaggggtatttgccattttaaatcctatttaatgaatactttagatgatgcctgagccacagtatcaccgcatgatattggatcagccatttgaaccgctttctttccagtgacatataccttagaagttctaggttgtgtcactccgccatgtgtttcatatggctttttaatttctgtatgttctgtaattggatcacctgctacgagaacagcaattcctccagtgaatactttactttgtgtagcattcacaactgttggaggccatgcttcatggccggcagtaacacacttatcataacttaatcctgacatctatgacctctcatacacatagcttcttaatttattagcccaacgactccaatttccaactatagttttagtataatttttaacgagagtttttcttactggagcaggaggatctgtcggttcagtagtatcagaagatgacctagaattactgccagaacctccagattcactttgttcttggtagtcatatattaatgttacttcgtaagtgaatgtcttctggaggttttgaggagctttccataaatacaactgagtatcagaatcagtaggaagttcttcccatgaagcagcagttttaaattcatcgcctaaacgatatttcaacgcgtcatttccaaatccaaacacagattcatatgttccgtataagcgattttcttctactaaaaccccaggagtttcttcgtaactagttatatttatagatactaacgtttcacctgtttctaattgagcggtaaaggtgacgtcgatagaagaaccttccatggattctcctaaatcagcgctcattggaagtatattagccaatgtcaatcctcgatccatcaattgtgtattgaccagatgaaatagaactcatagatgccattttttctgtccaatcaccaccaacgtcccaatcaactgtcccagcaactttccaagaaagatttccatttactgtgttagtttgatttccttcaactaaagtggtagcatctcctttaactgtaatgtcagcattaccttcaactacaatagtaacattacctttaactaggatagttccattgccttcaacagttttcgtttcgtcgccacgtacaaatattgtattgcttccatctatctggtgaagacgattatccatgttgtaataaatttctgatccaccgacgttagtctttttatcaccggctaccaaaaaattaccatcagcgttggttatatcatacaaattatcaacagtttttcttgttcttcttcctgacggtgatacttcttcataagttccagttggatgaactaatctgtatcgttcttgcccaggggtatcatcaaattcctgaatatgtccactttcagtttccattgtatgcacataaggatattcacctttatatgaagaaactggttctttgaataaaattctcgagtcatttggaataggagggtcagcagggtcagaagatttagctacagtagcagccattgctgatagagacctagctggggttttcacttcaacgccatatgattctaaatttcccgtaagaataatcatggtaacacgggatgcacggccttttgtttgttgataccataatgaatcacgaccggctttatacgctttttcccaatctcctgctaacatagcagttaacattgtgttaaatttagctacaccaccaacacccatctgaaatgccatattttctaacgccatttgacgagaacggttgacagcttgccagactggtcctactttagaatgtgatttaatgtcccgttgcatatcagccaaatcacgttcaaataaagtcgtcgcctcttccatcgtaatagaacctgggtttccagtaatttcacgaccaacttgttttgataaaactttattaatttgagccatatcacgaactggctgcttcatgataagatgaccaataccaattgtcggatatccttcggtatcccaataaacttttaatcttaatccttcatcacggcgaagcatttcagccattgacatatttggattatcatcggttggaatctctgatagtggtctatcatcgggatttattgcagtgtctaagttactatcttggataatgttagaagacgaatcatatcctacttctccgccttggtttaatacattagtatcatttcctaaacgtctaggatattgcccagttgggtcagaaaatccttcaagtctattcggtttttcgcgaactattccaccatacgtgccaaggacaattccgttagttttccatttgtctaaaaaatgaccataaactctagttccttctaccggtccagtaacagaacctccaattccagacattgctgcagaagttataggttgaataactgacatccatggtaatttttcagttggaatacccattacatcgccttgtgctctttgaggtggatgcagaccaaccacacgaacacgaacacgacctaattttaatgggtccattctatcttcaacaacaccaacaaaccaattaaggttattacttatcatttccataagatttctccattatacgtataaggtcgttcataaatgaattaatgtctgattttgctattatttttatttgacgaagtttttcattttcaagaacagcatcttcatacgtattaacagcagcaagtgctccttcatattgaggatattttctagctttatcacctttatcataccaaacatatggattatcatcgtatgatattaaattataaaatttttcaccgttctcattcacatgatatactatttggtctccacctacatttttgtatttttgtatagatgcttgataagctgcttcttgtgaagtaatccatccataatacgggtcataattatcattacacatcaataaaacccaatacaactgtggatttccatatatagtatttgctaattcttccgggcgtggtgaacctttgatataataagtacgtaagcggtatcccgcaagagcgcgtttaaaatagtctttatagtttctaaaaatatctgtcataggaatagtcggcgcgtttttattcaccgttttggccgcatattcaatcggatcaaaaaatgtaaagagcatgggccctcctgtttataaatatattatctatttataaggagaatccaatggcatattctggaaaatgggttcctaaaaatatatcaaagtatagaggtgaccctaaaaaaattacgtatagatcaaattgggaaaaattcttttttgaatggttagataaaaatccagaaattattgcatggggtagtgaaacagcagtaattccttatttttgtaatgcagaagggaaaaaacgtagatacttcatggatatttggatgaaagattcttctggacaagaattttttattgaaataaaacctaaaaaagaaacacaaccaccagttaaaccggcacatctaacaactgcagcgaagaaaagatttatgaatgaaatttatacatattccgttaatactgacaaatggaaagcagcgcaatctttagctgaaaagcgtggaataaaatttagaattctgacagaagatggattacgagctcttggctttaagggggcataatggctatttttcaaataattaatgaaagcactccccaagttccaaaggttaagcaatcattaaacgaaaagaaatggattcagataggtcttgaatataaaaaggccaaagcaaaaggaatgacaggaaagcaatttgctgaagaaagaggaatcaaatactctacgtttacttcagcaatgtcaaaatatgcttcaggaattaaaacggctgaaaagattcaaaagcttgaatcaaaaccaatgaataaactcaataagcaagaaagacaactgcttatgataaattcattcagacaaacattgcgtgataaaattcgtaatgaaggtgcagcaattaataataaaaccagaaagtggtttgctgaaactattaagcaagtaaaaggacataaagttgttcgcccgcagccgggacgaatatatgcttttgcttatgatgctaaacacaaggaaactcttccttactgggataaatttcctttaataatttaccttggtttaggtaaacataatttaatgtacggattaaacttgcactatattccacctaaagctcgtcagcaatttctagaagagcttttaaagcaatatgcaaatacacctactattactaataaaacgaaattaaaaattgattggagtcaagtgaaaggatttaggggtgcagaccaaatgattaaggcatatatacctggtaatattatgggtagccttgttgaaatcgccccgaaagactgggcgaacgttgtgttaatgccacttcagcagttcgtttcaaaaggaaaacgtttctctgcaaacaaagtctggtcaaatatctaattctattatcttccattcttttctattgtttgttctaattggaattgaatggaagggacttagacccattataccaccaacatttataaagcattatgaggaatatatgtcgcaagcactgcaacaaatttttaaccaagcaaatacaactaactttgtagtatcaataccacatagtaatactacatctgcttttactttaaatgctcagtcagttcctattccaggaattaggatacctgttactgataccgtgactgggccgtttggactaggcagagcacaacgtccaggagttacatttgaatacgatccactcatcgtgagatttatagttgacgaagagcttaagtcgtggataggaatgtatgaatggatgctaggaactagtaactatcttacaggcgaaaatactgcccaaaaaacaggtcctgaatacattacgctttacattttagataatagtaaaactgaaatcgtgatgtcaataaatttttataagccttgggtttctgacctgtctgaagtagaatttagctacacggaagattcagacccagctttagtatgcacagcaacgattccttatacgtattttcaagtagaaaaagatggcaaaattatagcagaagtttaatgcttcagtttcatgtgttataatcttaactaaatttgaggagaaacacatgaaactaatctttttaagtggtgtaaagcgtagtggaaaagatactactgcagattttatcatgaataattattctgcagttaaatatcaacttgctggtcctattaaagatgcattggcttatgcatggggtgtatttgcagcaaacactgactatccttgcttaactcgtagagagtttgaaggaattgactatgatcgtgagactaatttgaatttgactaaattagaagtaattatgattatggaacaagcattttgctatcttaatggtaaaagcccaattaaaggtgtgtttgtttttgatgacgaaggaaaagaatcagttaatttcgtagcatttaacaaaattactgacgttataaataatattgaagatcaatggtcagtccgtcgtctgatgcaagccctaggtacggatttgattgttaataacttcgaccgcatgtactgggtaaaattattttctttagattatcttgataaatttaactcaggttatgattattatatcgttcctgatacccgtcaagatcatgaaatggatgcggctagggcgatgggtgctacagtaattcatgtagttcgtcctggccaaaaatccaatgatacacatattacagaagctggattgccaattcgtgatggcgatttagtaattacaaacgatggttctcttgaagaacttttttctaaaattaaaaatacactaaaggtactataatgtctgaacaaactattgaacaaaaactgtctgctgaaatcgtaactctgaaatctcgtattcttgatacgcaggaccaagcggctcgtctgatggaagaatccaaaattctgcaaggaactttggctgaaattgctcatgcagtaggtatcactggcgatactattaaagttgaagaaatcgttgaagctgtcaagaatcttactgctgaatctgcagatgaagaatgatggaatttaaagacttttcaacgggtctttatgtagcagctaagttttcagaattaacacttgacgcgctggaagaactccagcgctctttacgtgttcctaatccagttcctagagaaaaaattcattcgaccatatgttattcgagagtaaatgttccatatgttccatcgagtggaagttttgaagtagcttcttctggacatttagaagtgtggaaaacacaagatggatcgactcttgtacttgtgctagattctgaatatctgcgctgtcgacacatgtatgcgcgggcactaggtgctacacacgattttgatgattacacaccgcatataacattgtcttataatgttgggcccttatcatttagcggtgatgtacaaattccggttgtacttgaccgtgaatacaaagagcctcttaaactcgattgggcagatgatttaaaataatttcacaaagttgtttacatactgatgaggtagtgatactattacctcatcaaaattaattaggaaaataaaaatgaaaactttcaaagagtttgctacaaaaactactatcactgaatcttcccacggtatggaagtaaagcttggaatggctttagctgaagctgagcgtcttttctctcgtattaaagaacttgctgctgcggtcgatccttcatcttttaaaggagaccaaactaaagttaaagcacttttagcattatgctccgatgcaggagaaattgctaaaaatggttctaagatgaagaaacgattagaagatttaaaataatttcacaaagttgtttacatagggttttagttgtgatactattaccctatcaaaacaaaaccaaatggaaatcaaaatgaaaacttaccaagaatttattgctgaaactgctgatgtaaaagttgagtttatttacattggcaagaaagataaaatgggtgaaatgcctcatggagttcttcgtgatgcattagataatttcggtcaactcgccgcagaagattacggtgataaaattgttgttactggtcctgctgcagttattgaaaaatgggcagcagaaaataaatcaatttttcgtaaaaaataagtttacttttagatagggtagtgatactattaccctatctactactgaggagaataaaatgaaacgttgtgaattaattcgaaatgttgctattgcaatttctgcttccgcttttagtttttcaatgtttgttggatttatatgtggattattgactacagcagaaaatgtgttttcacttgtagtagcatttttaattggtttaattgctattgttatggataaaatttctaaaggtgaataatgaacgttgaatattatgtatatgcggattacgaaaataatccgtctaaagatgaagataatcgtttaggtgtagatgctttcgattcccctgcggcggcatggcaatgggttgaaagaaccgatattccttaccgttatattgaagtggttgaccacgcaggaaacaagtatcctaaggaagcatatgttgcttccgggaaggtaaatttccttttgtttgcaggtgataattattatccccgtggtgggtataccgatttaattgctaaagcattctctgaagatgaactccgtgacattatcaaagaaaatgaaaacaaaccgatggattctaatcgctttgattggtggcaaatcgtaaatgctaatactcacactattgttgatgaaggctgataatgattctttatgcgaaagtatcatccattgaaaatggatataaatatgatcaagacgcggctaaagctttgattgatgattatggcattttaacatgttttgaagttgaaaaggtttacattgaccgttcatcttctcaagttaaattagtgaaggaagaacgtaaatttaatacagtaaattttgatttctttattgaaacagaaaaaggtcctcttgaatatgatattttcaagaatcctttgggtcttgaatgcatcgtaaatatgtattattataaatggtaaatatgctttaagaattatttgttattattaactcatatcgcactgattaataccctctatcatcaagggttcttgcttaagagcctttgttaataattgggaattagccaagttggtaaggcactggattttgattccaggatgcaaaggttcgagtcctttattcccagcgcgagaatggccaaattggtaaaggcacagcacttaaaatgctgcggaatgatttccttgtgggttcgagtcccacttctcgcaccaaatttgcggatatcgtataatggtattacctcagacttccaatctgatgatgtgagttcgattctcattatccgctccaatttaatttactccgtgtagctcagtttggtagagcgtctgctttgggagcagaatgtcgtaggttcaaatcctgccacggagactggaggcgtggcagagtggtttaatgcaccggtcttgaaaaccggcagtcgctccggcgactcataggttcaaatcctatcgcctccgccagttttgctgatttagctcagtaggtagagcaactcacttgtaatgagaaggtcggcggttcgattccgtcaatcagcaccaaggccctgtagctggaaggttcaagcaagcgactcataatcgccagatggtggttcaattccacccagggccaccaaattaatttggggagttatcccgtagaggtagcggtgtggactgtaaattcattgtcattgcgactcgggtggttcgactccaccactccccaccaatttggatgtgtagctcaatggcagagcgatcgcctgttaagcgattggttataggttcgaatcctatcacgtccgccaaatttgtgacaactgtcacattaatatctacttgacgcgattataggggttgaactgatcactcttctcttaatttcgtgtgaagacatcttgattgttggagtaggtattaatgtggccgtagttcagttggtagaactcgagattgtgattctcgtagtcatgggttcgactcccatcggtcaccccaattacggggcatagctcagaaggaagagcaaggaccttctaagtcctaggtcgtaggttcgatccctactgcctcgaccaattataagtgaggaaaatatgaaaggtaatgtttatttagtagttcatgatttaacattctattttaatcataatgatactgttatttctgaacgtgtaattaatttgctttatcagcatgcagattatgtttatgtcgaaaacgaatatggtcattggcaatttctcaaaaatcgttcatttggtttagatggttacaaatattttgatcgtaaagaccttttagatacaattccgttatctacacaatatcaaaatcataagtctttacataaatgccggctaattcgaaatgctgaatccgcgtatgaagcaattgatttgtggcgtaaacgccgtgaatatattgattctttaaaagaatattaagaaaccgggtcgctaccggtaagtcgtcggactgatgttccctggagtatagtttcctcccacagttttactgtgttctggctctttactatcacagcagaaacggcgcaccgaattatcgattcgaggaaatatctttgccgtaagccgagtagcgtttttgacggaacgttcggatatggtcgagatatggccttttaaaaatattgagtagcgtcaactacttaataaccgggttcgaatcccggcgtttcgtacaaacacttgccttagcaggtggaaccccgacaaggttgccgcaaggcttagccccgaccgaaaggttggggctttttggtataaatattagtatattaaatctacaaattaaaataggaaataagatgaaatcatatactcaatttttaaatgaagcggtgttaaatgaagcatctagcaccgaaattcaagctgttgcaaaagctgccattgccgcgggtaaatattcctataaagatgcttctgatgaatcgcgattccagtttgcacgcgacatgaaagcggaaggatttacgggaaatgcagttagtatggcctggaaaagtttagttgctactggcgctgcttttgcaaaggcttcgggtaaacctgctcctaaagcagatcctaaagcggcacaagaaaaaaatatcgttaaaggaattatcgctaaatatgaagctatccttaaagagcttttagtaatcaaaaccgaaggccaaaagttagcccgtgcttatagtttcaaagataatccacatgttcactctcttgagtatgttgaagacatccaaaaaattattaaagaccgcatttggtctgctaaacaaatcaaatgacattcttagccccgaccgaaaggttggggctttttagtttgaatcactcggataacgctgttacggatagtaacaaagtaataaataattaataaccaaccgataaattatttcaaggattttaaatgaaaacctatgccgaatttttaaccgaagcagcaaaattaccatctgaagcagatcttactaaagtattcttccaattggacccaaaagaccgcggcgattttcttaagtggaaagctaaagctattgaaatgtacaacatcgataatagttcttttacaatgagtcaagaaaataaattcaataaagcatttttcaaaatttctaagaaattggcatctggcgctcaggttcctaaatctgtgttagctactcctgaacgcgcacctgttaaaatttctaagaatatgttcgacactaaaaaatacgttaatgctttgaataaagctcttgatgcattggatgatgcaaagaaggcagcccgcgatcttcaagacgtgtacaccgattttgaccgcaaaactaaaggttctatttcaaatagcgaacgcaatagtgtaagtgtttattctgatagccttgatgttcttggcgatgcgtatactgaaattaaaaatcgtattaacactgcatctaagctaaaagctgctgcagaagctataataagtaaactaggtaaataattttaaatccctatctaaatgatagggctttttggtatctaggcctttctggacctctctaggcatcatttagtttataccctttataatatattatcctatcctttaattgcccatccctgccctagaattccctaaaaattttttcacaaaactgtttacatctctgttcttccatggtactatacaactatcaactactgatacagaaaacaacttggagaatgaaatggataattacggcgaactgttcaacttctttatgaaatgcgtttcagaagatttcggtcgtacagtgaatgatattaaagttatcggtcctgatcatccgatgtttgaaacttacgcagtaatgggtaatgaagacggtcagtggtatactgtaaaagttgtgattaatatgttcacagcagaaggttatgttaaactgtcttctaaagtttaccatgataacgacgaaatcgcagaagaatatttcaataatatgaaataagtttacgcaggctcatgattgagatattatgagcctataatttgacgatagagtattatactcctacggattttaaatctcaattaacctaaggaaatactatgaacacactgaagaaaattgttgagtttattcgcactaaacttggttctgctatggctaaaaatctatctgtcgaagaacagtatactgctgcagcagcaaaactacttgataaaattaaagatctaaaaactgcttctgttaaatctattaacgaagaaaaacgtattcgtgaacttgttatcgaaaagaatcgacaggccgaatcaaaagagcgtgaaattcgtaaacttctttccgaaggccaagatgtaacaatgcatgctaaactcggtttactatatcgtcgaacagctgagcagttgactactaaggctgacggttatgctgaaatgcgaattgaaatcgccaagaaagtagttgagttagatgatgctcgtcaagaacttgcggttaaattggaatatatccgtgaaactcgtgcagcgaatgcccttggaattagtactgctgatgatgtagttgaaattgcagcactgactaaggttgatattgaagatactcttgctcgagttgaaacctttaatggtaatatttctggggttgaaactacctctgccgatgttcaggaatatattaattctctgaaataatgataaggggcttcgggcccctattacttggagtaaataggaatgaaaatgcaaagtgatttcaattcaatgtttgaagagtttcaaagacaggttgatgttccagaccaattactaaatgctcttaaacgcatggcagaaggacgtaattactattgggggtcttcatatgaaactgatgaaagcctttccggaagattttctagaggtaaaaagtctttaatacgtcctggaatactcattaacagtattgaatcaattcattcattgacgtgtgattttgatgttgaatttactgatttcatttctcctgaatggacggtttgttatttaaacgacgattttgattatctcggtgtttatagtttaagtgacgcatggtttaaacgtaatttacaaaagtcaaatttattttatattgatactactgtaaaatttcagggcaagaaatatttctttactcttatagttgattctgaaacgaagcatgaaaataaacgtattcttagtaaaaagaatatcttaactattgttgatgatctttttgataaatttgtagaaaatcccaattttgaaagtgatttattactagaaaaatttgttaaggaatgtagagaatatgtcaaagccatcactataccttccaagtaaaccgttgaagtatgaattaaagcgtcagataatttctactgatgtgttaataggtcctgttatactcatatcatttgtaattctattgattattggaggtgttttagatgttatgactgatattgattctggcgaaatacttgtgttaatgctaattcttccattaatagttccacttttattagtacccgtaaattgggtaggatactggtatcaaggaaggcattatcgtaaacgcgtacgtgattggaaagcacagtgtaaaaagattaaaaaggaacatcagcttaaacttgctgcgtatgaatttgatgaaattatgaaatttgttaaggaatcacgatgcaaaagccaaaactaaataaagtcaaatattcgttttctgagtcatttttaatttttgctgtggcgttggctgcagctcttgcaggtagtctttttggattgttaattgactgtcttattttaaacatcgacggcacagtaaatataacagaagtttggagtgagctttgttatactaaaattatttcattgttttcattctttggtatcattttatattttcattatgataattttaaaataaattggcaaagaaaaaaagattacaaaatacaattaaaagaatataatagctacatgtcttatattgaaaatgagtcaatgaaagagtttgtgagtgattgtaggaaaattaaatgattttaaaaactcgctggtatgatttagatgatggggatgatggcatttcagttgatagagttgactggaatggttgttccgaagatatgaaaaatttgttgattagggagtttagaatgggatatcaagcagctaagccatttactgtaacagatgataagttcgtatgtattcaaaacggtcgcgctaagttaacgaatgctgattggttcacagataagaaggttcttctgtggtatatcattagtcttcctatatcatcgttcgtattttacttttttataaaaaatccaatggacagaataggagattgggttcttttaactatacttgttaatatttttacagcagcagtattatcaggaatatggcgtatgttcattgaaatgccatggcgtttacgcagacaacaaaagatttttgatgaaaagaaatatgctcaaaatttaaataactttatcactgaatgcaggaaattaaaatgaaaacattatcagctggtattatcttcatgacagaagataaagatttatttatgggtcgggttactggttctcgtaagcctggaatgatggcacatcgctgggatattccaaagggacgtgtagaaagttctgatttgaatgcactggaagctgcaaaaagagaatgcttagaagagaccggttttagcaattataatccagaccttctagaagacctaggtgtatttaaatattctagtaataaagacttacagttattttattatacgattccagtagagcatgagatgtttagaaattgccattgcgagtcttattttgaaaataaagatggcgttatgattccagagatggatgcttttgctcttattcctcgtactcagtggcaatatgtgatgggtccttcactttaccgaataatgaacagcctcttttaatttataaataccttctataaatacttaggaggtattatgaatatatttgaaatgttacgtatagatgaaggtcttagactcaaaatctataaagacacagaaggctattacactattggcatcggtcatttgcttactaaaagtccatcactaagtgttgctaaatctgaattagataaagctattgggcgtaattgtaatggtgtaattacaaaagatgaggccgaaaaactctttaatcaggatgttgatgctgctgttcgcggaattctgagaaatgctaaattaaaaccagtttatgattctcttgatgctgttcgccgctgtgcattgattaacatggtcttccaaatgggggaaaccggtgtagcaggatttactaattctttacgcatgctccagcaaaaacgctgggatgaagcagcagttaacttagctaaaagtagatggtataatcaaacacctaatcgcgcaaaacgagtcattgcaacgtttagaactggcacttgggacgcgtataaaaatctataaagttgtttactttctcctagaattgtgatagtatattcacagttacttggagggataaaatgactcgtattaatttgactttagtatctgaacttgctgatcaacatttaatcgcagaataccgtgaattgccgcgtgtttttggtatagttcgtaagcatgtggcaaacggtaagcgcgttaaagattttaaaatatcttctaaatttattttaggttctggtcatgttactttcttttacgataagttagaatttttgcgaaagcgtcaatcggacattataacggaatgcttaaaacgcgggttcagtataaaagatactgaagttcctgacatcagcgatattccagtagaatggaaaaatgattataatccatgcaaatcagctattaagttgagtcaacaacgactcgatgaaaaaattttaatgaagccacactggtataagtattacggcaaaaatatttacatttaaataacatgggaataacctggacctcatgattctgtgagggattcccgccaacctgtaataaggtcgagcccaagtgcggtaatgggtaaatacagaaatggacaattcatgcgccatggaatggcccaaacctagagagaacaaaatgagaacatttttaactggtccttatctatccctgatgaatgcttttacacaccattctgatgctagagtagaagaaatttgtaaaaacgaatatatcccgccatttgaagacttacttaaacagtattgtacacttcgactagatggtgggcgtcaatctggtaaatcaactgcagtaactaattttgccgctaattggttgtatgacggtggaacagttattgttctttctaatacttcagcttacgctaaaatttccgcagataatattaaaaaggaattttcgcgttattctaatgatgatatacgttttcgtttatttactgattctgtgcgcagttttattggtaataaaggaagcaagttcagaggtttatcgctttcgcgaattttgtatataattgatgagcctgtcaaatctcctgatatggataagatttatagtgtccatattgacactgtacactgctgctgtaatattaaatgttgcattggtggtattactcgtccacagtttttcgtaatcggaatgcaatgatgacagacactcagcttttcgaatatctttatttttcgccaaaaactattaaaaataaattggtgaatcattttgaaattttggcaaataacaacgtcttgagcgaattttatcctaagcaatacaaattacaaaaaggtgtattcaaaggatgcagagttttgtgtactgctcctaatgcaagattaatgaataaaattccatattttaccatggaatttattgatggaccttttaaaggactaatcacccaaagtttaatggcatatgattctgagccatttttaattaaagaacagtcttggataaatttattttctaattgaggttatatgaaagcatatcaaattcttgaaggcacgcataaaggtactatttattttgaagatggtattcaagcacgaattattgtttctaaaacctttaaagaggactcttttgtagacccagaaattttctacggtttgcatgcccgtgaaattgaaattgagccacagcctacagttaaaattgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtacctttactgagagcttgtaatggcaaagataattattgaaggttctaaagatgtgttaaatgctttcgcagaatggtttagtaattcaggcgaacagcaatttaatgaagcgtggaatatgggtgatattagtggaatttatcctacgacagaaatttctgttcagggatatggcattcatgaacctattcgtttagttgaatacgatttatgtactggtgaggaagtcaaatatgattgaagatattaaaggttataagccacataccgacgaaaaaatcggtaaagtaaatgctattaaagacgctgaagttcgtttaggacttatctttgatgctttatatgatgaattctgggaagcactagataattgcgaagactttgaactcgcgaagaattatgctgaaagcctcgatcagttagctattgctaaaacgaaactcaaagaagccagtatgtgggcttgtcgtgctgtgttccaaccagaggaaaaatactaatggctcaattaagcgcagggtttggttatgagtattatactgcccctcgtcgtgtgtctgctgctcctaagaaaattcaaagtcttgatgacttccaggaagtagtccgtaacgctttccaggactatgcacggtatcttaaagaagattcacaggactgtctcgaagaagatgaaattgcttactatacgcagcgtcttgaacagctcaaaaatctacatgaggttcgtgccgaagtttcaaagtctatgaataaattgattagatttaaagaataactgtttacttttcctcttgactgtggtataatttttctatcagttaagaggagaataacatgactatcaacacagaagtttttatccgtcgaaataagcttcgtcgtcactttgagtcggagtttcgtcaaattaacaatgagattcgtgaggcatcaaaagcagcaggggtctcatcgtttcatctaaaatattctcagcatcttcttgatcgtgcaattcaacgggagattgatgagacatatgtttttgaattattccacaaaataaaagaccatgttttagaagttaatgaattcctgagtatgcctccgcgtcctgacattgatgaggattttattgatggggttgaataccgtcctggacgtttagaaatcacagatggaaatctttggcttggatttacagtttgtaaacctaatgcgaagttcaaagacccgtcgcttcaatgcaggatggcaattatcaatagtcgtcgtttaccaggaaaggcttctaaagcagtaattaaaactcaatgaggtaagcatgagaaaagcactactcgctggtctattggccatttcaatgatggcacatagctccgagcatactttcagtaatgtccaactcgataacatgcgttacgcgtatcaattcggggaacaattttctaaggatggaaaatataaaacacacaaaaatatccacaagagcggattaggtcatataatggctgctattttatggcaagaaagctctggcggagttaatttaaaatctaaaccaaagcatcatgcctatggaatgttccaaaattatttgcctactatgcgagcgagagtcaaggaacttggttataatatgaccgatgctgaaataaaaagaatgttgaataaacggtccaattcagcttcctgggcgtacattgaactttcttattggttaaatatacataagggcgatataagaaaagcaatatcctcttataattcgggatggaatgttaaagctggttctaaatatgcttctgaagtcctagaaaaggctaattaccttaaaaataataaacttttggaaatagtaaatgactaaaattttggttttatgtataggattaatttcattttctgcgttagcagatacatcatatactgaaattagagagtatgtaaaccgtactgccgcggattattgtgggaaaaataaagcatgccaagctgaatttgcgcagaaattaatatatgcatataaagacggagaaagagataaatcaagcagatacaaaaacgatacattattaaaacgatatgctgctaaaaagtggaataccttagaatgttcagttgcggaggagaaagataaagccgcttgtcattcaatggttgaccgtttggtagattcttataatcgaggattgagtactagatgattgtaaaatatatcaagggcgatattgtcgcccttttcgctgaaggtaaaaatattgcgcatggatgcaattgttttcatactatgggttcaggcgtagcgggtcaattaaccaaagctttccctaaaattttggaagctgataaattacagactgaatggggtgatgtaactaaactcggttcttactcagtctatgaaaaatactttaggactcataaagcgtattgcttcaacctttatactcaatttcaaccagggccaaattttgagtattccgctttaatgaattgtatgttagaattaaatgagtttggtgaaaataaactgattaaacctacaatctatatgcctaggattggtgcaggcataggtaaagggaactgggatattattgaggggattttagatacatattcctctaaattagaaattgtgattgttgattgggaaccgttattatgaatatacattatccacatccatatgacccaaagaataaggcagtaattattcgtcaatgggaacgcatttgccgtactaaatgtccaattaatagtccgcatgatgtagataaagactacattggaacattcgttgaatatacctttattgataagaaaggtcgtaaacagcatgtagaagaatactgcttaaaggttacatggttatgagccaaactagtattcttaaaaatgcccattgtgaaaagtgtaaatggccagttgtttttgctttatgcaacgatgaaatggcttgtgatttcgattattggtgctattgttctaataaaggatgcatcaatcataaaggtgaaggattttattcgggattttatccttatccagatttcgttaaagaaggtaaaccgaaatgaatagttttgagttacagtatgaagtgttacgtgagcttgataatttaattgaactcgctgtcaataaaggttttgccattggaatcggtcaaaaagatactggtcatttaactatggaaatatttaagcaaaagcgaattattttaaaactcctggaaattaatatatgagtctgagtaaagaacaaaaagataaattgtttgagcttatccatgaacttctagatgagcatacagaagcaaacaccttttatgatgaatacggcccgctatctcccgaacagcaagaagaatttgctgatcggtttgataagaaagaaaacgaattaatagcttatgtgaatatgctttaagaaggtgatatggcgagtttaatttttacttacgcagcaatgaatgctggaaaatctgcttctcttttgactgctgcacataattataaagaacgcggaatgggtgtattagttcttaagcctgctattgatactcgcgattctgtctgtgaagtcgtttctcgcattggaattaagcaggaagcgaatattattacggatgatatggatatttttgagttctataaatgggctgaagcacaaaaagatattcattgtgtatttgtagatgaagctcagtttttaaaaactgaacaggtgcatcaattaagtcgaattgttgatacatataatgttcctgttatggcttatgggctaaggactgatttcgctggaaaattatttgaaggttctaaagaacttttggcgattgcagataaacttattgaactaaaggcagtttgtcattgtggtaaaaagctattatgacagctcgattaatggaagatggaacaccagttaaagaaggtaatcaaatctgtattggtgatgaaatttatgtttctttgtgtagaaaacattggaatgaattaactaaaaagctcggttagtgcaaaagttataaataggtttatctaactaaaggggtatatatgctacaattaactgaaaagcaacttcgcaatcttactgttcttcaattagatgaaattcgtagggaagttggaaatatcatttcagctttgcgtcgagaagtatcactcaaccaatctccggcagactatactagattgcgaaattttgaaaaataccttgataaagttaaggccgtgcatcggcataaagtaaatacaggacaaaaatgataggaggcctttatggccttaaaagcaacggcactatttgccatgctaggattagcgtttgctttatctccaccaattgaagcgaatgtcgatcctcattttgataaatttatggaatctggtattaggcacgtttatatgctttttgaaaataaaagcgtagaatcgtctgaacaattctatagttttatgagaacgacctataaaaatgacccgtgctcttctgattttgaatgtatagagcgaggcgcggagatggcacaatcatacgctagaattatgaacattaaattggagactgaatgaaattcagcgacttttcacaaagtggaaaaccttcaaaggcagatgaatacttaggtttattaatggctgcacaagcttattttcattctgcgcattttgaaactaaaagttatgctagacacaaagcatacgattttattttctctgagttgccagatttgattgataaatttggtgagcaatatttggggtattctggtagaaaatacacgccttctattccagatgccagtaaacttcctaccgacacaattaaaatgattgatcgcatactagaccaatctaacagcatttataaagaaatgcctccagccattcaaagcacgatagatgatattactgggatgttttaccagagtaaatatcttctttccctcgaataacattagtctccttcgggagacttttttcattttaccggtttactttccatttgagctgtgatactatacaactatcggataaagaggagaacatcatgaaaattgaagcacttaatcaagaaggaaatatctacgtcatcattaatggtgattttttcgtcgacatggatgaagttactagtgaagaacttgtagaacttcttaagaaacgttatgatatgtgtgatgaagctgcaactcatatggcgtgtgcaatattctctctttcatatgtggtggaataatgactagaattgaacaagcagataaaattaaagaattggtagctttaattcgcaaagcagatgaggaacttagtgactttgcttggttttcggcaggcattgcaaataaaggtattgaaaaatttgaagctaaagttgataatgctttagaagcgttagatatgtttcttgatgaaattatcgatcataatacgagagtttaattatgctaacacgtgaacagtttgaaaaaatcattaaattagcacgtgatattgaaatagattcataccaattagcagttgagcattgtgaaggatattcatacgacggtatagaagcagctaaaaaggatttggataaatccaaagctaagttagttcaatatcttgaaatgattaggtggaataatgaaaactgaaaagcagatgtttttaatgaagctaattgaagaatatgctaatgcagtttctgactatgagtattctgctcgggaaagaggtacagctttcgcaaaggaagaaatgaaaatcatggttgatgctcacacaaagcttcagaattttattgaaaacgtcatttaatggtttacaagttgacaagattatgatatagtaatcttgtcaactgccaaggagaagagaatgaaagttttgtttgttgtgtatgtgatgattcaatataattatccaatgtttacttataatctggtgaacaacattattgatattattcaaaggagtatgtaattgtgggtgagtcgaagagaatcaatatgaaacgattagtattagaagttagtccgctttttggtgaattagctatagaaaaagtaaataatatgtatcgtttgacacaagaagacgatatgctatattttacgcctagtgaaatcattcatttaacccaaattgaatatccttatactgataaaatagtaagcatcaatgatgagcacaaaattcatttttattcttcatgcccaggatttaatattaaaagtgagtcaatgtgtttatcagttatccattgggatagctttatagctaagattaaatatttttattattctaatgaaagaaaacatagtttaaaatggctcaaaaattgcaatgctattattactaacgcttgcaatcagaatgatgaaactgttttaaacgtatcaaaatgctatgaagatggtgatgtcttaactattcgtcaaattgatgattttcgatcgtatattgtcacatttaccaaagacgaagctattgcgctaaagacttatctcgattctgtcattccaactatgatttcaaagtgaggaaatatgtttatttcaagtggaagtggtttaattcgtgttgaatttaaaaatgacatcttccttattcaaggagatgatattattaaaatgagttatgatgaaattaagaaaatttgtaatgctcttgaaagtcatggaaaagtgaacgctgttattgatattggtgatttatgggtgacactttatgaagtatccgaaggatttaatattgaagatgaaaacaacatcttagctattgataaaagaagcgatttgtttgatgtgttaaaagtttatgaacagtcaaacggtggaagaaaagctgtattgatttatcaaaaaccacattcatgtggaactgcttcaatcatttcagatattgaagatgaaactgatacttatatgtgtgttttaaaagctggtggtgaccgtcatccggattttatttctattcgtcaaaacaatgaagaaatttcattatcaaaatcagaagctgaagctatgattaagtatttaacaactgttacaccttcaatgaaaggataattatgattattaatgaaaactcttggcactataaattattcaaattgtttaacgatgaatggcaacgacctaagacgctgtgcgcatacttttggtctattgttatccctacatttttcgtttcttttttcggatgtactatactcgtaggtctaactatcatctgcgcagaaatcatacagaaatggcttatttttggtagtttatggactcttattccatcagcatttatacttgccattttgcttgttttacttattgtcggttcatttgttattcctgcacaactgcgtgaaaaatataaagattataaatggaaaaaggattatgctttacacgtagaaaatattgatagggcgtataaaggtttacctcctattcaacccaagaaatcgattatcgttgaatttttaaaagctcgtaaagctaaagtatgtcctgttattgaatataaggctgaatgatgaaaacagtaatgaaaagctattttggtagtcatctttatggaacttctaccccagaatctgatgtagattttaaagaaatctttgttcctcctgctcgtgatattcttatcggaaatgttaaagagcacatgagtaaaaacactaacaacacatcatctaaaaacactaaagatgatattgaccatgaactatacagtcttaaatatttctttaaattagcagcagatggtgaaactgtagcgttagatatgcttcacactccacctgaactagtggttaaatctgatttgcctgatgtgtggaagtttattcaagacaaccgttctcgtttttatacgactaacatgaaatcctatttaggatatgtccgtaagcaagcttctaaatacggcgttaagggttctcgtttggctgcattacgtgatgtattgaaagtagttaatcaaatccctgagcaatgggttgattaccaagaagatggttctattaagcagcgtcgtactaaagttgaagatattaagcatcgtcttccagaaaacgaattctgtgaatgggtgttccataatcatgagaaaacaggcccacagacgttctacacagtgttgggtcgtaaatatcagacaacgctttctcttattgagcttaagcagtcactgaacaaattagatgctgaatacggtgaacgtgctcgtaaggccgaagccaatgaaggtattgactggaaagctatgagtcatgcttgccgtggtggactccaactattggaaatttacaaaactggtgacttggtttatccactccaagatgctccatttattctcgacgtgaagttgggtaaacatccatttaaaacggttcaagagtttttggaagatgtggtcgatcaagtagaagcagcatctactgaagcttctaagaacggtatgcagcaaaaagtagacatgggtttttgggatgacttccttgagagggtttatcttgaaaaccaccgaagttattataaatgatagggagccttcgggctccctttttttatttcaaaaatttttcacaaaattgtttacaagcataaagctttatggtactatacaactatcaactgatacggatttggagaataaaatgaaaactgtaactatcaataagggtatctacttcggtaaagaaatctctggaacttttgagctcttaggtgaatggttcccagataatgctccggtagatgcacaaggagatggtaaagtttttgttgaaattgacggtaagcgtcgcggtgtttgggtttacaaatcagacatttcatatgatggtgtaaaagttgaagaagttaaagaatcgtatgaagatatgaaaacccgcattaataaaagatttaatgttatgggaatgatgacgaatggtattattaacggaaacattcgttcattaattatctctggtgcggcgggtattggtaaaacgtattctttagataaagctttaaataaagcaaatgatattggatacattgaatataaaagcattaatggtaaaatctctggtattggtctttatgagcagctttggaataatcgtgaagagaattctgtacttttgattgatgatgtggatgttttctctgatatggacattcttaatcttctgaaagctgctctggacaccggagagacccgcaaagtctgctggagcactgcatcttcttacttagaagaaaaaggcattgagcgtgagtttgaatttaaaggaacgattgtttttatcacaaacgttgacattgaccgcgaattagaccgtggtactaaacttgctccacatttacaagcattagtttcccgctcggtttatttagatttgggtgttcacactaatgaagaaattatggtcagggttgaagatgttattctttcaactgacatgatgcaaaaacgcggtctttctgatgaagaaacttataaagcattatcatggatgaaagtcaatgttaatcgtttacgcaatgtttcactgcgtactgcactttatcttgctgactttattatgaccgacaaaaacggttgggaagaaatcgctgaggttactcttctgaaataattcataagaggccttctatgacaaaaaggcagttcagaaatagattatatggactgccatcaaaaagatgattagaattaaactggtaaatggaggtagtgatgttatactcaaaggctcgtgaaatttacgaaactaaaattaaagacgcggttcatcagttcgcaacgacaatgcgttggacaaatgactgggaatactccaagaatcataagaagcccttggtgacaagaaaggctcatatgttagtgttaatagaccgtgagcagattaaagcccgagaagccctccagaatcataaaaaggctgcctttgaatggtttatggataacactgctcctgagactaagaaagcggtaagcgcatggttcagtggaaaaaattgtgaaagaagtttcttttagtggtttacaagactgttcctctgtggtactatacaactatcaactacggaggaacacaaaatgaacgctaaagatattttcaacctggtaaattacaacgatggtaaatttaaatctgaagcacaaagcaagttctttaatgacatctcaatcggaggtgaaatcacggttgacggaggacaaatttacaaatctcgttggaattggatcgttattatcgatgagattggtattgtagaaatttacaagaatacgaataaaaatcgtacattacactggtctcgtgatactaacgaacagtacaaaaaggataaagcatctaaattatctcgtgtaactcaagaagatattgagttcatcaagaaagatattttgatgtatgataacttaattgctgaagagcaagctgttattgataaatttgatgagattaaagcttctcgtgaaattcctgattttatgaaagaatcagtaaatgaacgatacactctcatttcagagcgtattgaaacttacaaaaagcaaagagctgaacgccaaaatactcttcggaagtttgaagaacggttaaagacggtactcgcataaccgctttataccaaggatggtataatggttctaagcccttttaattgagattattatgaaacagttgataattaaaagattgaatttattgatatgttgtttatgtgtagtagttgcatatggttattacgcaattaatgattatatgcattataaagattatgatgttactgtagttaatacctttacaggaactcaaggaaaggggtctagtttatcgtttattgctgtatatgaactcaaagacggttatagatttagcgaatatatttcaccagagatgtattcatcaatagaaaaaggcgataatattactgtaagtttacgtcctttcgacgtaaaacagacattgtttgataatattgtttggttctttggaatggtattagttcaatctgtgtgtggtgcttatatagtctgttccatcttattctgtatatttagtaaaattgaaattgagtgaggaaaatatgtcagtagtaattaataatgtcaatgcagtaattaaatctttagttaataaaaaattgaatgaatggactgtacttcgtcgtggagagccagataaattttttcatagatttaacccaactttggatttgaatgttattgacagagatgttcatgctgaaattttagataaatttaaagttgatattgggtttggattagataaacatttacaacgaacaaacgggtctggaatgggtttatctaatcgcatcatgaaagcccttaataaaattggagcgttgtctcgtattaatgcgagtgaaatccttcgcaattataataaaggatatgacctttatggtcgattaatgccgaaattatcatttgaccaaatgatcgcagatttgtgggaaaatcaacgacgattattagcattaggcgctcgattagctaaaggtctagataaacaaatgatttttaagaccaataatacagaagaccttaaatgctttaaatttagtattcgtggcgatgattattatatcagagctcactctacagattatgttaatatggggcatcatctctgtttagcttttgaagttttaaaagaagccggaacattagaatattcatctggtgcaaaatgccctattggttcaagttgtattttaatttatcgcccggatgaatccagttcaactaaattgcctacaaaacctgtaccagttcgtagtaatgaaaaacattctgagcaaattgattattttaataagcaaattgaagagctgaatatttctattcaacaatatgatgatgaaattttcagactatctggactgagtagtaaagctaaatctgagcgtgaaaagttaattaaaattatcgatttacttaaatcttaaggaacaccatgaaaactcgttctcaaattgaagatatggttcgtaatgccagctatactcgtgatgctatgacatttttgtgcgaaaataatttagaccttggtaaagttaattgttccattcacgcctttaaacatctgaacagcagtgaatgggtgcgtaattttaatgaagctgggtatattactcaaatgactgctcgtgaacagctcaccgatttctgtaaaactattgattataaaaatcctctatttgttcaaggtgttggtcagagtaaggtcgatttatcatctggatttttcaatccaaatcattatcgtattgaatggagatttattgctctattccgtaaacaattaaagcaaattttgtctactgctagtcgattaaaaggttctgatattaacttaaagaatctgaaatttgatggttatactcttcagatggaagtaagaccattaaaagaaaataacagaactgcacgaattagctttaaacctaatacaaaaaattctctttcaatttgtgaatgccttaaatcacagttgacagaagcatttaagtatatggatgtagttgccgcggttcagtctaagattttacctcattttgagcgaaattgggaacatacaacaacgtatgaacttgatatgatcgtttcatttaaatacgattttttgagaaaggacgaagtcccgcaagagaaaaagcaggaagtgcaagatatcttaaatttatccaattactcatcaaacgatcctaaattttggatgtatagttcaggtaataaagatacatggaaattcaataaagtgaattttcttcctgttgaaaatccgagtcttaaacctgttgaaaaatggcacgcggatgcgattgagaagtctatcaaggcagtagatgatgaactcgttaaagcaactaatgaagtgttagaagctgaaaagatgctagaaaaagctcaagaaaaagtcaaaaatcttacgaagcaacgttctaaactgaacaacgcactaaatgcactaaactagtttactttgccacaaggatgtggtataatgttcttactttctactgaggagattaatatgactcgtaacgaatatatcaaatcattcaatagcgttattgatgataaagttaaacctgtgtttagtcagaatagtgttatttccattatcaatcaatggctcaataatattgatgcaagtattgtttcttcaagcaaatttattcatgaagttcataaaatttctagtcgcgaatataaagatgatattaaggaaacttttaaaggttctcgtcttctttcatatttagttaatcaagatattcttggtaaatttgggaaagaaattaaacgaactaaagatgtagtaggatacagttggttcggtgatgttaattcttatcatcttaataataaagaagaccctgagaatatttttactcgtcgttggattagtaattttagacttttcaagaagcaaattctaaaatcagcttctaaattatgctatggtgattatcgtcaaatccatccttgggcttctgatatgattatcataaaagaatatgagcttgataaaaataaagcagctatttttgtgaattatgaattttttacaccagaagctaatcaaaagaacattaataaatttttctcaattgctagcgatataactcgtcagttagagaccgcattactttgtatggaaacagtagaaaatattcatacttatccttttaagaatatatgcggttgggaaggatataaaattgtagttagtctccgtgaagtaaagtgtgcgtactcaccgactgataaagaaatttaccaacaaaaatgtgatgaaattgtgaatactcctaaagaagaaactacccttgaggaactaatggaatgtcttgacgattcgcctgaaccagtagaaattcgtccagaagttattgcactagaaaaagcttataaagaagttctagaaatttctaataaagcgcagaaagaatatgagcaggctaaaaagatttgggaagaatccgttaatcgtcttgatcgtcttgaacaagctttacagttaattaagtaatttaaagccaaggatggctcggagtataaaccattaaccaagtgagaagaatatgaaaactcgtaaacattatattgattattttgacagtcttattactaaacaccgtaattatcagatcgggcacagagcagtaatcaataatattcttcgtgatttccttcaatatgttggtcaggaaaatcatatctgtaaagatactcaaaacgcttattctcattcgttaggcaatttgcttgaatggtttaaacgttctcgtatgttatcttctactgtagctcatgagaacattaaaaactttatgaagccgagcttcattaaatctgagacatctataaccgatttggttgaatttactattgttaatgatgttaaaaagactcatttggctgattggttttctaccattcctgaaactaaatttgctgataaatttgcttgtcaattcaatgaccaagtgaatatgctttttaagcatgctcgcaaactatttaccgcgggcgatgaccgtacaaatacagttcatgttaaggactgggttattgctgatgaagtaacacacaagccaggtggttcatcagtattaattaatatccaggttccttattattactcacgtaatcttggcaccatgacagctaaagaaattaataagcacaacaaaactattcgttcgttgtcttataaactccgcatgatgttaaaaattatggacgtagtggaaatgtatgacgaaaccgaagataatggttcaatgttatacagttcacgcattctaattaaactgaagaaccctaatacatataagacagttgtaaaagagcctaaagtagaaaaggttgataatctgagtgaagaacgtgaatatctcaatgcccgtttgattgaagttgaagcccaaattgcagaacacaccaaattgttaaaagctcttaatgcaaaagcaaatggtttacgtaatgctattgaggtattgaaatgaaaaagcgtttattagaagacattgcagcttcaagtaattccagtttaattaaaattattatggctggtgaggaagatgatatggaaatgcgtggaaagattcacggctgcgacgatttagattttaaacctccagcatgggatgctattatggctatggttgaacgacgtgaaagagcttctaaaaacgttcctaattgccctgaatgcggtactgaacaagttcagttgattaactggcgtaaaccagagcttgaatataaatgccgtcaatgtaaacataaattcagtaagcatgctccggaaatggttaaattgcctgactctactgagttctttaaagaacttgtgagtgttcaaccaatgcctaataatattttggattaaaaatgaccaagcgtaaagaatatatggaggctgctgaaaaggcagtccgtgaattagcaatagcttattataatgaacacggtaaatttcctgatagatacagcgtgcttaaatctgctttaactcgttcatataaaaatatgctatcagaagtaagtgatattatatacaaacataaagaacaaacgggccaaagtcttgattacgacgagacttttaaacaagtactaggaattaaggaataatatgtttaaagtatatggttatgatagcaacattcataaatgcgtgtattgcgataatgcaaaacgtcttttgactgtgaagaaacagccgtttgaatttatcaacattatgccggaaaaaggtgtttttgatgatgagaaaatcgctgagcttctgactaaactaggtcgtgatactcaaatcggcttgacaatgcctcaggtatttgctcctgatggaagtcatattggtggatttgaccaactgcgagaatattttaaatgatgctcgaaggaactgactatattcatgattaccgcggaagcgcggtatatgtaggtgatgaagttgcagtttattatgggtatggaactttgatgacagccaaggttattcaaattaaaaataatcgtgctaaactcgaagtttattattctaatggcgaaaagtctatttctaagtggaaatacggcgattgcatggtcaaactggggtaaatatgatttacgatattaatgtatcacgagctccgtcaatggttactattccagccgaagaactagatcgtcttcagaaaattgaagaacttctttgggaaattgaatgtgacctgccatcaggactagaatcttggattgattatgaagaacttaataagcttcggggttaaaccttggtgggcggctagatgggaaactgtagagccagagccggaagaaccggtttacactgatgaagaaacaatatataatgaaccaacgataaatgacttaattgatatggagatgggacatgattacagtagataagtggtttagaattaatcgtgctgatacagggctgtgtaattactggccggaacttagtgcaggtactgtctttaaagttcgtgaacttgcaaaagaatgtgaagatgatatagagcctgatactggaattattgaaattgaactttccgacggaaagattattaacatctacgataagccaattacgtattggtgcttgtggaatactgaatccattgaaaatggcgaaattgaagaagttgtagagcgaactaatcaagttgttcagaagcctaaagccgattttcaaggtgaacgtatttcatacgcattagctaaattagctgcacaagaaaataacgatggctatgaaggaaatttgatgcaagctgcggcagaatatattgaatggcttgaaacccaaatttctttttctgaccaaaagattcggcaatataagcgattgaatcaaatgttttacaatacttgaaaataataaatacccttatctatttaaggtaagggtttattatgttattgactggcaaattatacaaagaagaaaaacagaaattttataatgcacaaaacggtaaatgcttaatttgccaacgagaactaaatcctgatgttcaagctaatcaccttgaccatgatcatgaattaaatggaccaaaagcaggaaaggtacgtggattgctttgtaatctctgcaatgccgcagaaggtcaaatgaagcataaatttaatcgttctggcttaaagggacaaggtgttgattatcttgaatggttagaaaatttacttacttatttaaaatccgattacacccaaaataatattcaccctaactttattggagataaatcaaaggaattttctcgtttaggaaaagaggaaatgatggctgagatgcttcaaagaggatttgaatataatgaatctgacactaaaacacagttaatagcttcatttaagaagcagcttagaaagagtttaaaatgacaattgaaaaagaaattgaaggattgattcataaaactaataaagaccttttgaacgagaatgctaataaagattctcgtgtttttccaactcaacgggaccttatggctggtattgtgtctaaacacattgccaaaaatatggtcccgtcttttattatgaaagcgcatgaaagcggaattattcatttccatgatattgattattcccctgctcttccatttactaattgttgtttagtagatttaaaaggaatgcttgagaacggatttaagcttggtaatgcgcagattgaaactcctaaatcaatcggtgttgctactgcaattatggcacaaattactgcacaggttgcttcccatcaatatggcggaacgacttttgcgaatgtagataaagtactttctccttatgttaaacgcacatatgcaaaacatattgaggatgcagaaaaatggcaaatcgctgatgcgttgaattatgctcaatctaaaacagaaaaagacgtatacgatgcattccaagcttatgaatatgaagtaaatactctctttagttcaaacggacaaacaccttttgtaacaattacatttggtacgggaactgactggactgaacgaatgattcagaaagcaattctgaaaaatcgtattaaaggtcttggtcgtgatgggataactcctattttccctaagcttgttatgtttgttgaagaaggtgttaatctttataaagacgatccgaactatgatattaagcagcttgctctagagtgtgcaagcaaaaggatgtatcctgatattatttcagctaagaacaataaagctatcactggttcatctgttcctgtttctccaatgggttgccgtagtttcttgagcgtatggaaagattcgactggtaatgaaattcttgatggacgtaataatcttggtgttgtaacactgaatcttcctcgtattgcgttggattcttatattggaacacagttcaatgaacagaaatttgttaaattattcaatgagcgaatggatttatgttttgaagctttgatgtgtagaattagttccttaaaaggagttaaagcgactgttgctcctattctttaccaagaaggtgcattcggggttcgtcttaaacctgatgacgatataattgagttatttaaaaatggtagaagttcagtgtctttaggatacattggtattcacgaattgaatattcttgtcggtcgtgatattggacaggaaattttaactaaaatgaatgctcgtcttaaacagtggactgaaagaactgggtttgcttttagcttgtattctactcctgctgaaaacctttgctatcgcttctgtaaacttgatacagaaaaatatggaagtgtaaaggatgttactgataaaggctggtacactaacagtttccatgtttcagtagaagaaaatattactccgtttgaaaagatttctcgcgaagccccgtatcatttcattgcaacaggtggtcacatttcttatgttgaacttcctgatatgaaaaataacttaaaaggtcttgaggctgtatgggattatgctgcacaacatttagattattttggtgttaatatgccagtagataaatgttttacgtgtggaagtacccatgaaatgactcctactgaaaacgggtttgtttgttctatttgtggagaaactgatcctaaaaagatgaacacaataagaagaacatgcggttatttgggaaacccgaacgaacgcggatttaatctcggtaaaaataaagaaatcatgcatagggttaaacaccaatgaattatgacagaatctattcaaatctagttaattctgctgaacacccatctaagccccgtcaaactaaagccgggtatgaacttcatcatataattccaagaagtatgggtggttcagatgatttagacaacttagtatttttaacttataaggcccactatactgctcaccatttattggctaaaatatatggtggaaagatgtatgatgcatattggataatgagtaatagtaagcatagaaaagttacttcttcacaatacgcgtatgcaaaagctaagaaatttgaaaatcagcgtggcgcaaaaagaagcgataaaactaagaagctaatgagcatagctaggtctaaagtaactcttcctgatgattttggaaaaaggatatctgatgggctaacaggaagaactttgtctactagtcataaagagcatatcaaaaatagttctagaaatcgctttaacaccaaaacggttattggctattcaccagacggaaatacaatagaactaactggagcaactgaaataagaaatgcaggattttttcattctgctgtttataaatgttgcaaaggaattcaatctattcataagggatatacttggaaatataaagatgaattatgatagaatttatccatgcgatttcgttaacggccctggatgtagggtcgttctcttcgtcactggatgtttgcataaatgcgaaggttgttataatcgtagtacttggaatgctcgtaacggacagttattcactatgaataccgttaaagaacttgcgtcccatttaagcaaatcgtatatccaaggccttaccttaaccggtggtgacccactttatccacagaaccgagaagagatttcaaatttagtttcttgggttaaagcaagatttcctgagaaagacatttggttgtggacaggatataagtttgaagatattaaacaactagaaatgcttaaatatgttgatgttattattgatgggaagtatgagaaaaatcttccgaccaaaaagctgtggcgaggatcagataatcagcgactttggtcaaataccgatggggtgtggacacatgattaaattgaattacattatggatactataaatgatatgatttttcattttggtccagaattttattcgcagtatagtttagtgcttatcaatgcttggttaatcaattaagggtaaaatatgtataaatttcgtaaaggtttagctgattttcttacaactgtaacgttctttctgtttatggcagttggagctattttccttattccttttattgctatatttttcgtgattagtttgatttctccagaaaagagtttatcttctagcgagttcaatgagcgtctggataaaattactaacaagctgaattctgttcttgataaaaaggcttaattatgattagttttgagcggtatgtggtagagagttggaagggttttgatatgttcggtaatgactattatttttacgaatgtagtctaaatcctagtttttgggctggacgtgaacgagatctcgaagaaattaatgctcgtgccgaattgttaggtgaactgcctacggtttattttacctttgatgcatctggatttgttatccaggtttattttcctgaagaaaactctggtgaggattctgttaacccgccatactgggcttatcaaggaattatttctcgtggaacaaaactcgaacttaaagaataagattgaaatctatggcatccccgaagaagtaggtcgttgtcctggatgtcaatcagttacaaaacttctaaaggagctcaatgctccttttactttctataaagttcttacaaataatggtaagattgagtatgatcgtccactgattgtatctcttgctaaacgtgctggattcacatctcttaacattcgttatccagtcattttcattaatgattctagacaaaagaacattaaacacttcaaagaaactctcatttcacttggatatgatagagatatcatagaagattaagacgggccctctgggcctttctttctcacattctgtatattaccattctaagttatcgttcccttcttatcattccctaaaatatttttcacaaagttgtttacaacaagttcaaaccgtggtattattaacatatgaattgcctttgaggaattgatatggttgataaagagattaaaagagatcagtattatcgtgttaatggacatatcgttattgttacagcagtagatgattttgaggttcactatactttacttaaatggaataaacgcttgatttgcgatcgtgctgcatttagttcagttgctaaggaaattaaactccatgggtaaaacgtatcgtcgtaaagacttgaaagttcgtgattatgactatttcggaaagcgtaaagctcctgatggtgtaagtcataaagatatggttgaaaacatttttcgctcagataaatggcgtagaatgaaaggtattgattcagaagttaaagatgagttaaatcgtcaattacgcggtgaagtaagaaagttgaaaaaatcagtttacattgacgatgattttgattataatacttctcaacgagttgctaaacgtaaatcaaacgagtgttatcgttatagctgaggaaaatatgaatatcaaacgaatgctttttaagcaggggttatatactttaaatgttactccaaaaggcgatacaactaagtggtcagtaaatgactggattaaatttattgatgaaaatggcaattgggaaatttaaatgaatcctgaatctaaattatcgcagcgaattgctgaagaacgcgccaaatttttccagaacatgaaacacaatggtattgaggatgaagtttttctaaattggttctggaataataagtacacagcatgtgaaggagctttgtcattgtcagtcgcaatgatgtacgaaggctggaagggtgccaaaaagtttagctaagggcttcggcccttttttggataataaaattttaacgtaattgaggataatgtatgactattcaaattaaaaacgccatcaattcttacgcatatgataaagtagtttctttgctagaaaaaggcgatattgtaactcctcaaattttggataaatgggaaaaagagcttcatcagacgatgaaacagaatgatcagaagattggacgcaatactgtccgtgaattgttggttcaatatatcttgtcagaatttgatgttaaagcttttggtgtagaatctaaagcttatcaaaagcatgaaatttccgataaaactattcgtcgcatgaaaaatcaacgcaagaaaaaatttgctgacctgaaaattactaaggcataattatgaatgaagctcttattaacgatttacgtcttgctgggtatgaagtaaatacaaacggcagtggtttaactcaaattgaaggaaatggattcattcttgagtatgaatttagccaatggtggttatatgccaattacggcgaattgattgaatatgttgaccaatttgattcactagatgcagctcttgaagcggctaagttgatgaatgtatgaaatttattaatatttctattactattgaaaattatggcattttctatgttgaccaatacatgaaaatttcatttttcccaaataagactggtgttggatattgggaaagccatgtttctgaattaaatgaaagtgaatatgttagtacacatgaaaagtttttagactttttatatcatgctgatctaactagtcattatatagatattcatgaatttaaaaagatgatggagaaagtattccaagcatactgcttacttagataactgatatcctctatgctttaagatagatcttcaaatattatgatataatagatctatgaattgagctaagaggtgaaaatgtcagaaactaagcctaaatataattacgtaaacaataaagagcttttacaagctattattgattggaaaacagaattagcaaataataaagacccaaataaagtagttcgtcagaatgatactatcggattagccattatgcttattgcagaaggcttatctaaacgtttcaacttttcaggatacacccagtcttggaaacaagaaatgattgcagatggtatagaagcttctattaaggggcttcacaattttgatgaaacgaaatataaaaacccgcatgcatatataactcaagcttgttttaatgcattcgtccaacgtattaaaaaagaacgtaaggaagttgcaaagaaatacagttacttcgttcacaatgtctatgacagtcgtgacgacgatatggttgcgttagtagatgaaacttttattcaagacatctacgataaaatgacgcattacgaagaatcaacctatagaacaccgggggctgaaaagaaaagtgttgtagacgattctcctagtttggattttttatatgaggctaacgattaacctctccggattcttggaagaaatacctgaagttgaagctattccctatttacttaaaatgtatctcagggaagttttagctcttgacattgatattgatccagaaaatccgtatgataccgcttttaaatctaatggtgtagaattaaactatcggtatcatttaacagatgatgatttttattttatattagagaaataatatgactgataaacccgaaattaatgatgaagtgaaaaagcttatttcttctattgaagaaaagaaccgtcttgaagcagaaagaaaagcaaataagttattgtctaaaaataaacgcgaactgaatcgtctttataagcacgctcagatcgcagctgaaaataataattttgctcaatacgaatatgctatcaagaaaagtcgggatattctaaaacagccatataacgatgaactcatcagtattctttggaagactactagatcgcagattgaggatatgattgatgcttacacacgtaaaattcaagcgtcttaaaattaatgcaggatttactgaatctttgaatggtcatctttgtgtgaaaatttctgaaaaagaataccatgatagttcaattaaagaagttaatcctcctattgtaagagcagaccctaatatgaaagtgtgggttgattcttatcaagtcaaaaaatggtggcagttatgaaagatgaacacccagacttctgaaatagattataataaaattcgttcctctaaagtagaaatgatgagacgctttaaagagtcttacgataaagctaaagcagaaggaactataacatataggcgcagaaaatttagaagctctaatgagcctttgtatggcgtattatgtggataggagcttcggctcctatattgctttataaatttttggtaaaataaaccaaaacaaagaggatattaaatgaaagtatgtatttttatggctcgaggtcttgaaggttgtggtgtaacaaaattctcactcgagcaacgtgattggtttattaagaatggtcatgaagtaactttggtttatgctaaagataaatcatttactcgtacaagttctcatgaccacaaatcattttcaattccagttattttagctaaagaatacgataaagcacttaagctggtaaatgattgtgatattctaattattaattctgttcctgctacttccgttcaagaagccacgattaataactataaaaaacttttagataatattaaaccttctattcgtgttgtagtttatcagcatgatcattctgttctttctttgcgtcgaaatttgggattagaagaaactgttcgtcgagctgatgttatttttagtcattctgataatggcgattttaataaagttctgatgaaagaatggtatccagaaactgtttctctgtttgatgatattgaagaagcaccaacagtatataattttcagcctcctatggatattgcgaaagttcgatcaacctactggaaagatgtttctgaaattaacatgaatatcaatcgttggattggtcgtacgactacatggaaaggtttttaccagatgtttgattttcacgaaaaattcttaaaacctgctggtaaatccactgtaatggaaggtcttgaacgttcccctgcttttattgcaattaaggaaaaaggtattccgtatgaatattacggtaatcgtgagatcgataaaatgaatctcacgccgaatcaaccggcacaaatcctagattgttatattaatagtgaaatgcttgaacgaatgagtaaatctggctttggatatcagttgagtaaacttaaccagaaatacttacaacgctcactagaatatactcatcttgaattaggtgcttgcggtacaattcctgttttctggaaatctactggcgaaaatttaaaattccgtgttgataatactcctttgacctcgcatgatagcggtatcatttggtttgatgaaaatgacatggaatcaacattcgagcgtattaaagaactgtcatctgaccgagctctttatgaccgtgagcgagaaaaagcatatgaatttttgtatcagcatcaagattcaagcttctgctttaaagaacagtttgacattattacaaaataaagggcttcggccctttagctttatacggagtttgatataatgatatttcttggatatgtgatactttttctcgcgttttatctattcactagagcatgttggattgggttctttagcactccagatggatttatttcaataattttattttgcatttcaatgacggttcttgatatatgaaaattttaaatttaggtgattggcatttaggtgttaaagctgatgatgaatggattcgcggtattcaaattgatggaattaagcaagcgatagaatattctaagaaaaatggaattactgtatggattcaatacggtgatatttttgatgtacgaaaagcgatcacgcataaaactatggagtttgcccgtgaaatagttcaaatgcttgatgacgctggaatcacattacatactattgtaggaaatcacgatctccactacaaaaatgtaatgcatccaaatgcctctactgagcttttggctaaatatcctaatgttaaagtatatgataagcctactacagtagattttgacggatgtttaattgatttaattccttggatgtgtgaagaaaatactggtgaaattcttgagcacatcaaaacttcatctgcttctttttgtgttggtcactgggaactgaatggattttatttttataaaggaatgaaatctcatggtcttgaacctgatttccttaagacttataaagaagtgtggtctggtcacttccatactatctctgaggctgctaacgtcagatatattgggacaccatggacactaactgcaggtgacgagaatgaccctcgcgggttctggatgtttgatacagaaacagaacgaatggaatttattccaaacaatactacctggcatcgtagaattcattatccatttaaaggaaaaattgactataaagattttacaaatctatcagtacgtgttatagtaactgaagtagacaaaaatctaacgaagttcgaatctgaactagaaaaagttgtgcattcattacgagttgtgtcaaagattgataactctgtcgagtcagatgacagtgaagaagttgaagtccaatcgcttcagacattaatggaagagtatattaatgcaattccagacatcactgattctgaccgtgaagcacttattcaatatgcaaatcagctatatgtagaggcaacacaatgacttttgatgaatttaaaaatgttatgatgagtcagcattttgaatgcgaagtaaaagatgatattgggcataaagaaattattgaatattggtttgaaccgttagaggttgaagataattgtattaaaaaggttacagtctgcactgactgggctgtatcttttaacttcaacattttagataatgacacacctaaatcattacgagatatggccgtatcttgtattaaggatgcatactgtgaagttttcgacatttgacattaatgatgaattcatagcaaacattgattataccgaagaagattctagatatgttggaataatttatattacatcgaaaacagcacaaggcgttgtttgcatggctgaatttgatgaatactttttagattatgatgatatgatagaatggtctaaaagatacattaaaaggaatcttttgtgaagaattttaaactaaaccgagttaggtatcaaaatataatgtcagtaggtggaaatcctattgacattcaactagataaggttcaaaaaactcttattactggacgaaatggcggtggtaagtctactatgttagaagccatcacatttgggctttttggcaagccatttcgtgatgtaaagaaaggtcaattaataaacagcacaaataagaaagaacttttagttgaactgtggatggaatatgatgagaaaaagtactatatcaaaagaggacaaaaaccaaacgttttcgaaatcaccgttaacggtacacgtcttaatgaatctgccagcagtaaagatttccaagcagaatttgaacagcttatcggaatgtcatatgccagtttcaagcagattgttgtccttggtacagcagggtatacccctttcatgggtttgtcgacccctgcgcgaagaaagcttgtggaagacctgcttgaggtaggaacattagctgaaatggataagcttaataaagcactaatacgtgaattaaattcacaaaaccaagtgcttgatgttaaaaaagatagtattatccaacaaattaaaatatataatgataacgttgaacgccagaaaaaattaacgggtgacaaccttactcgtctacaaaatatgtatgatgatttggcaaaagaagctagaacgctaaaatcggaaatagaagaagctaatgaaagattagttaatattgttttagatgaagacccgactgatgcatttaataaaatcggtcaagaagcagttttaattaaatcaaaaattgactcgtataataaagtcattaatatgtatcacgaaggtggattatgtccaacctgtttgtcacaattaagttccggtgataaagttgtttctaaaattaaagataaagtttctgaatgtacgcattcgtttgaacagctttcaacgcaccgtgataatttaaaagttcttgttgatgaataccgagataatattaaaacccagcagtcgttggcaaatgatattcgcaataaaaagcaatctctaatcacgacagtagataaagctaaaaaagttaaagcagctatagaaaaagcatcatccgagtttattgaccatgctgatgaaatagcactgcttcaagaagaacttgataaaattgttaagacaaaaactaatttagtaatggaaaaataccaccgaggaattttgactgatatgctcaaagattctggtattaaaggtgctattattaaaaagtacattccattatttaataagcagattaaccattatcttaaaataatggaagcggattatgtgtttacattagatgaagaatttaatgagacaattaaatcccgtggtcgtgaagattttagttatgcttcatttagtgaaggtgaaaaggcacgaattgatattgctcttttatttacttggcgtgatattgcttctatcgtatctggtgttagtattagtacattaattcttgatgaagtgtttgatgggtcatttgatgccgaaggtattaaaggtgtagctaatattataaattcaatgaaaaacactaatgtttttataatttcgcataaagaccatgacccgcaagaatatggtcagcatcttcaaatgaagaaagttggtcgatttactgtaatggtttaatttataagagattatgctttaatttattagagtataatctctatggaggaaaaacatggaatattcaactggacagcatttattaacttttcctgaaataaaacgatatattctgagaaataatttttctaatgaagagcatatagttactgaatctatgcttaggaatgcatttaaagcagaatatacaaaaataatgtccaatagaaatgaagcttggactgttactgattattatgactaaaggtgtattatgactaaaattactgtgaattatactgttgatgtaaaagatattcagccaaaacacgtgcgttctgaatcaaatccacaaaaccaaaataaaattcgtcgagcatgggttttgtctctttctgataacgcaatggaagttattcagaacaaaattaaatctgcacctgctcgtcatgcgtattatgaagctatcgatcgtgaagtaagtaataaatggattgaactaatgcgcaaacatactacagaatccctaaacgccggtgctaaatttattatgacttcatgtggtgaacgccttgaagatgattattgtggtaatgcagatgaacgtctgattgttgctgcacaaattgttgccgaaacaatcgcaactgattttaatcgttaattgctttattaaattagttataaaattaaatctcatttgaattgaaggaaattacatgaaactgtctaaagatacactgaatattttgaaaaatttcgctactattaactctggcattatgcttaaatccggtcaatttattatgactcgcgcagttaatggtacaacttacgcggaagcaaatatttctgacgttattgattttgatgtagcaatttacgatttgaacggttttctcggtattctgtcgctagttaatgatgatgcagaaatttcccagtcagaagatggaaatattaaaattgctgatgctcgttcaacaattttttggccagcagccgatccgagtacagtagttgctcctaataaaccaattccatttccggtagcatctgttgttactgaaattaaagctgaagaccttcaacaactgttgcgtgtatctcgtggtctgcaaattgatacaattgctatcacggtaaaagaaggtaaaatcgtaattaacggttttaataaagtagaagattctgctctgacccgtgttaaatattctttgactcttggtgattatgatggtgaaaatacatttaatttcattatcaatatggcaaatatgaaaatgcaaccaggaaattataaacttctgctctgggcaaaaggtaaacaaggtgctgctaaatttgaaggtgaacacgcgaattatgtggtagctcttgaagctgattctacccacgatttttaataaagggcttcggccctttataatttacactaaaacttgaatgaggaaattatgattaccgtaaatgaaaaagaacacattcttgaacagaaatatcgtccatctactatcgatgaatgtattcttcccgcctttgataaagaaacctttaaatctattacaagtaaaggtaagattccacatattattcttcattctccttctccaggaacaggtaaaacaactgtagcaaaagcattgtgtcatgatgtaaatgctgatatgatgtttgtgaatggatcagattgtaaaattgatttcgttcgcggtcctttgactaattttgccagcgccgcttcatttgatggtcgtcaaaaagtaatcgttattgatgaatttgaccgctcaggattagcagagtctcagcgacatcttcgttcctttatggaagcttatagttcaaactgtagtattattattactgctaacaatattgatggtattattaaaccacttcagtcacgctgccgagttattacgttcggtcaaccgaccgatgaagataaaattgaaatgatgaagcagatgattcgtcgattgactgaaatctgtaagcatgaaggaattgctatagctgatatgaaagttgtagcagctttggttaaaaagaattttcctgattttcgtaaaactattggcgagctcgatagttattcatctaaaggtgttttggatgctggtattttatcactggttactaacgatcgtggtgctattgatgatgttcttgagtctctcaaaaataaagatgttaaacaactcagagctttagcaccaaaatatgcagctgattattcgtggttcgtaggtaaacttgccgaagaaatctattcacgtgtaactccgcagagtattattcgtatgtacgaaattgtcggcgaaaataatcagtatcatggtattgcagctaatactgaattgcatttagcttatcttttcattcagttagcatgtgaaatgcagtggaagtgatatgagcttatttgaagatgatattcaattaaacgagcatcaagttgcttggtattcaaaagattggacagctgtccaatccgctgctgattcttttaaagaaaaagctgaaaatgagttttttgaaataattggagctattaataataaaactaaatgctctattgctcaaaaagattattcaaaatacatggttgagaatgcattatcacaatttccagagtgcatgccagctgtatatgctatgaatttaatcggttctggattaagtgatgaagctcattttaattatctgatggctgctgttcctcggggtaaaagatatggtaaatgggcaaaactggttgaagattccaccgaagtattgattattaagttacttgctaagcggtatcaagttaatacaaatgatgcaattaactataaatcaattcttactaaaaatggaaaactatctttagtattaaaagaactaaaaggtttagtcacggatgattttttgaaagaagtgactaagaacgtaaaagaacagaaacaactcaaaaaactagcattggaatggtaaaatgattgaaattactcttaaaaaacctgaagattttctgaaagtaaaagaaactttgactcgtatgggaattgctaataataaagataaagttctgtatcagtcctgtcatattcttcagaaaaaaggactatactatatcgttcattttaaagaaatgcttcgtatggatggtcgccaagttgaaatgacagaagaagatgaagttcgtcgtgattcgattgcatggctgttagaagattggggactgattgaaatcgttcctggtcaaagaacttttatgaaagatttaactaataatttccgagttatttcttttaaacaaaaacatgaatggaaactcgttcctaaatatacgattggtaattaatatgactgctataactccgcaagaatacatggcgtctcttaaagaaaaatataatctttctgcaacagaaacacttttcgatttaccagaaaaccttcaactaaaatttcaggtagaatttcaaaaattaattcacccagaacaaaaacactttactgcagtcgttaagtcaattaatgcagatggaatgacaatttttcaccgacaaatagtactaatttaagcaaggggcttcggccccttatttggagtataatatatcaagagcctaataactcgggctataaactaaggaatatctatgaaagaattttatatctctattgaaacagtcggaaataacattgttgaacgttatattgatgaaaacggaaaggaacgtactcgtgaagtagaatatcttccgactatgtttaggcattgtaaggaagagtcaaaatacaaagacatctatggtaaaaactgcgctcctcaaaaatttccatcaatgaaagatgctcgagattggatgaaacgaatggaagacatcggtctcgaagctctcggtatgaacgattttaaactcgcttatatcagtgatacatatggttcagaaattgtttatgaccgaaaatttgttcgtgtagctaactgtgacattgaggttactggtgataaatttcctgacccaatgaaagcagaatatgaaattgatgctattactcattatgattcaattgatgatcgtttttatgttttcgaccttttgaattcaatgtacggttcagtatcaaaatgggatgcaaagttagctgctaagcttgactgtgaaggtggtgatgaagttcctcaagaaattcttgaccgagtaatttatatgccattcgataatgagcgtgatatgctcatggaatatatcaatctctgggaacagaaacgacctgctatttttactggttggaatattgagggatttgacgttccgtatatcatgaatcgtgttaaaatggttctcggtgaacgtagtatgaaacgcttctctccaatcggtcgagtaaaatctaaactaattcaaaatatgtacggtagcaaagaaatttattctattgatggcgtatctattcttgattatttagatttgtacaagaaattcgcttttactaatttgccgtcattctctttggaatcagttgctcaacatgaaaccaaaaaaggtaaattaccgtatgatggtcctattaataaacttcgtgagactaatcatcaacgatacattagttataacatcattgacgtagaatcagttcaagcaattgataaaattcgcgggtttatcgatctagttttaagtatgtcttattatgctaaaatgcctttttctggtgtaatgagtcctattaaaacttgggatgctattatttttaactcattgaaaggtgaacataaggttattcctcaacaaggttcgcatgttaaacagagttttccgggtgcatttgtgtttgaacctaaaccaattgctcgtcgatatattatgagttttgacttgacgtctctgtatccgagcattattcgtcaggttaacattagtcctgagactattcgtggacaatttaaagttcatccaattcatgaatatatcgcaggaacagctcctaagccaagtgaagaatattcttgttctccgaatggatggatgtatgataagcatcaagaaggtatcattccaaaggaaatcgctaaagtatttttccagcgtaaagactggaaaaagaaaatgttcgctgaagaaatgaatgccgaagctattaaaaagattattatgaaaggcgcagggtcttgttcaactaaaccagaagttgaacgatatgttaagttcagtgatgatttcttaaatgaactgtcgaattatactgaatctgttctcaatagtttgattgaagaatgtgaaaaagctgctacacttgctaacacaaatcagctgaaccgtaaaattctcattaacagtctttatggtgctcttggtaatattcatttccgttactatgatttgcgaaatgctactgctatcacaatttttggccaagttggtattcagtggattgctcgtaaaattaatgaatatctgaataaagtatgcggaactaatggcgaagatttcattgcagcaggtgatactgattcggtatatgtttgtgtagataaagttattgaaaaagttggtcttgaccgattcaaagagcagaacgatttggttgaatttatgaatcagttcggtaagaaaaagatggaacctatgattgatgttgcatatcgtgagttatgtgattatatgaataaccgcgagcatctgatgcatatggaccgtgaagctatttcttgccctccacttggttcaaagggtattggtggattttggaaagcgaaaaagcgttatgctctgaacgtttatgatatggaagataaacgatttgctgaaccgcatctaaaaatcatgggtatggaaactcagcagagttcaacaccaaaagcagtacaagaagctctcgaagaaagtattcgtcgtattcttcaggaaggtgaagagtctgtccaagaatattacaagaacttcgagaaagaatatcgtcaactcgactataaagttattgctgaagtaaaaactgcgaacgatatagcgaaatatgatgataaaggttggccaggatttaaatgtccgttccatattcgtggtgtgctaacttatcgtcgagctgttagcggtttaggtgtagctccaattttggatggaaataaagtaatggttcttccattgcgtgaaggaaatccatttggtgacaaatgcattgcttggccgtcgggtacagaacttccaaaagaaattcgttctgacgtactgtcttggattgactactcaactttgttccaaaaatcgtttgttaaaccgcttgcgggcatgtgtgaatcggctggtatggactatgaagaaaaagcttcgttagacttcctgtttggctgatagaataaatctagggacctccgggtccctttttcatacaagtaatataaatctatacttatgaaaaacagatgattctggacatttagaattccctaaaaaattttcacaaaactgtttacatctctgttcttccatggtactatacaactatcaactactgatacggatttggagaataaaatgaaaattgttatgggttgcttagcagtttgtttagttgcattagcagcagttccatttgttagtgttgaaaatgatactcaacctgtgattgaatctagcactgttattcacactaatggtaaaatatcagttaaaattgatgataatcttcatgtgaatacaaatggatctttaggtgtgcaaatgggtaatacctgcataagcactactggagtaattactacttgtatttgaggaaattattatgaaaatcgctattttggttattgcattaggtcttactggttgtgtagctcaaggaccggtagtaaatcagtctgatgtaggaaaaattgtaaactgttcaagcaaattttataatcctaatgtcaagtgttataaagaagctccaaaacagacagtagaacaaatgcaggcgaattttgacgaggctattcgtccagatgaatctgctcaagcatatcgtaattcggatgtaattacacgcgaagaaaaaattgaaaactactgcgccgagctttgggctaattgggccaataattaccaatggcgtactggtaaaaatgctccgatggagtatgtagtgaattcttataattcatgtgtaaaaaatttgactaagtgaggaaaatatggaaactttagtaacaggttcaatttttatggttttagtttcaggtgtgttggctattattatatacatgcttccatggtttatcgccttgatgcgtgggtcaaaatcgacagtaggaatctttttcacatctttactgtttaactggtcaattattggttggtttattacatttatttggtcaattgcgggtgaaactaaaaagtctgcacagccaaatcaagtaattatcatcagagagaaggaatgaaaagcaaaattatagcagtgttgcttttaatcttgatgattataataagtatatactatagtgtaacggttcctcttatgattccaactattattttaggttggagtttattactgttacaagttaaatatgaatgtatcaattgaggtttaaatgattagtgactctatgacagttgaagaaatccgtcttcatttggggcttgcattaaaagaaaaagatttcgtagttgataaaactggtgttaaaactattgaaattattggcgcatcatttgtagcagatgaaccgtttatttttggcgctcttaatgatgaatacattcagcgtgaacttgaatggtataaatctaagagtttgtttgttaaagatattccaggtgaaacaccaaagatttggcagcaggtagcatcttctaaaggcgaaattaactcgaattatggttgggctatttggtcagaagataactatgcccagtatgatatgtgtttagctgaacttggtcaaaatcctgattctcgacgtggtatcatgatttatactcgtccatctatgcagtttgactacaataaagatggtatgtcagatttcatgtgtactaatacagtacagtacttgattcgtgataagaaagtcaatgcggtagtaagcatgcgctcaaatgacgtggtcttcggattccgtaatgattatgcatggcaaaaatacgtattagataaattagtatctgatttgaatgcaggcgattcaactcgtcagtataaagcaggttctattatatggaatgttggaagtcttcatgtatattctcgtcatttttatttggttgatcattggtggaatactggcgaaactcatattgtgaaaaaagactataaaggtgagtggaaatgattcaattcgtaattccaagttatcaacgtgtcggggcagtttctgcccttaatatgtttccgactgattatgaaccccatattgtggtgcgtgaacacgaagaaaaagcttattatgatgcttatgggtctagagctaaaattgtaactattcctgatgatgttaatggaattgccggtactcgtaaagcaattactgatatgtatgcaggtcaacgaatctggatgattgatgatgatactactattcgtatgagttcaatacgaaagagagacgataaacggcgtgtagataaaattaatcaattaactcgtgaacagttctatgaattaattcaatacgttgaagatgccatggattgcgggtattatcacggtcatgctcgtctaccaatttttaaaattacttcatcttggggcaattatcgtgaaaactcatatggattcacgaatacatggtatgacctcggaaaacttacgacagaacaaattgggtatggaaaaattgatttatgcgaagatatgtatgcatttctcaatttaattaatcaaggttatccgcatttggccttgttcaaatatctagttgtatctggaaaatcacacgctcccggtgggtgtagttcaattcgtagtaattctaaacataatagagcgcttgagcaaatcaatagagagtttccagagcaagctcgttggaaaacatcgaatattgaaaaacgaaaatcgttgggtgaagaagacgagccattaaaggttcttcgcatgtgtgtttcgcgtaaagaaaaatcagaagcatttcataagtttaatgctattcatccaatagcagttgattaatgcctaaatttattgtgttataattactatatctttaaccagtgaggaaaatataatgatgcctatggaaaaaatgaatgtctattgcagatttaaaatcccgtttgattaaagcttccacttctaaaatgactgctgaactgactacatctaaattctttaatgaaaaggatgtaattcgtacaaaaattccaatgcttaatatcgctatttctggtgcgattgatggcggtatgcagtctggtttaactatttttgcagggccttctaaacactttaaatcaaatatgtctttgactatggttgcggcatatttgaacaaatatcctgacgcggtttgtctattctatgatagcgaatttggtattactccagcttatttgcgatccatgggagttgacccggaacgtgtaattcatacgccaattcaatcagttgaacagctgaaaattgatatggtgaatcagcttgaagctattgagcgtggtgaaaaagttattgtattcatcgattcaattggtaatatggcttctaagaaagaaactgaagatgccttgaatgaaaaatctgtggcagatatgactcgtgctaaatcactgaagtcattattccgtatcgttactccttattttagcattaaaaatattccatgcgttgcggttaaccatacaattgaaacaattgaaatgtttagtaaaaccgtgatgacaggtggtacaggcgtaatgtattcggctgataccgtattcattatcggtaagcgtcagattaaagatggttctgatcttcaggggtatcaatttgttctaaatgtagaaaaatctcgtaccgttaaagaaaaaagtaaattctttattgatgttaaatttgacggtggtatcgatccttattctggattgttagatatggctctagaattaggatttgtagtaaaacctaagaatggttggtatgctcgtgaatttcttgacgaagaaaccggcgagatgattcgcgaagaaaaatcttggcgtgcaaaagatactaactgcactacattctggggtcctttatttaagcatcaaccattccgagatgctattaaacgtgcttatcagttaggtgctattgatagtaatgaaattgttgaagctgaagttgatgaattgattaactcaaaggttgaaaaatttaaatctccagaaagtaaaagtaaatcagctgctgatttagaaactgacctcgaacagttaagtgatatggaagaatttaatgaataaagatgatttagacttagatctagaaattatcgatgaatccccctcttcggagggggaagaagaaagaaaagaacgtctttttaatgagtctcttaagataattaaatccgctatggaaaatgttatccaggagattgtcattaaactagaagatggttctacacacattgtgtatgtgacaaaattagattgggttgatggaaaagtcgtaatggactttgctgttcttgaccaagaaagaaaagctgagttagctcctcatgtagaaaaatgtattacaatgcaactacaagatgcatttaataaaaggtcaaagaaaaagtttaaattcttttaaggagtaagtgtggtagaaattattctttctcatctcatatttgatcaagcttatttttcaaaagtttggccatatatggattcagaatattttgaaagtggtccagctaaaaatacattcaaattaattaaatctcatgtcaatgagtatcatagcgttccatctattaatgcgttaaatgttgcattagaaaatagttcatttactgaaacagaatattctggtgtaaaaacacttatttcaaaactggctgattctccggaagaccacagctggttagtaaaagaaacagaaaaatatgttcagcaaagggcgatgtttaatgctacgtctaaaataatcgaaattcaaactaatgctgagcttcctccggaaaaacgaaataagaaaatgccagatgtaggtgctattcctgacatcatgcgccaagcattatcaatttcatttgatagctacgttggtcatgattggatggatgactatgaagcgcgttggctatcttatatgaataaagctcgtaaggttccatttaaactcagaattctaaacaaaattactaaaggcggagctgaaactggaacactgaacgttttaatggctggtgttaacgttggtaagtcattaggactttgttcattagcagcagattatttgcagcttggtcataacgttctttatatctccatggaaatggcagaagaagtctgtgctaaacgtattgatgctaatatgcttgatgtttctcttgatgacattgatgacgggcatatttcttacgctgagtataaaggaaaaatggaaaaatggcgcgagaaatctactctcggtcgtttaatcgttaaacagtatcctactggtggagcagacgctaatacatttcgatcacttttaaacgaattgaagctcaagaagaattttgttccaacaatcattattgtcgactatctaggtatttgtaaatcttgtcgcatccgagtttattcagaaaatagttacacaactgttaaagctattgcagaggaattgcgtgctctggctgttgaaaccgaaactgttctttggactgcagcacaggttggtaaacaagcttgggattcttctgatgttaacatgagtgatatcgcagaatctgccggtcttccagcaacagctgattttatgcttgcggtcattgaaaccgaggagttagcagctgctgaacaacaacttattaagcaaatcaaatcacgatatggtgataagaataaatggaataagtttttgatgggtgttcaaaaaggaaatcagaaatgggtagaaattgaacaagattctactccaactgaagtgagtgaggtagcaggttcacaacagatacaagctgagcagaatcgctatcaaagaaacgaatcgactcgagctcagttagatgctttggcaaatgaattaaaattttagtttacaagctgacaagactatggtatagtagtcttgttggttaaatgaggagattgttatggaattggtaaaggtagtttttatggggtggtttaagaatgaaagcatgtttactaaagagatcacaatgatgaaagatgacgttcaatgggctactactcaatatgctgaagttaataaagcactagttaaagctttcattgatgacaagaaggtatgtgaagtggattgccgaggataatatgcatatcgttttatttaaacctactccgtataatgtcaggaaaaatactcaattcaaagcacttattgcagatacgtgggaattagtattagatattccggcagaagaaagccctccatttggtcgagtggaatttattaagtttgctgtgcgccctacaaagcgacagattcgtcaatgcaaaagatactttcgtaaaatcgccaagttagagaaacagtttgtaacatgtgattacgcaaaagttttaaaataactgtttacttttattggaaattgagatactatataaacataaactactgaggagattatcatgaaaaaatttatctttgctgcaatttttgctttatcttcttgcgctgctcagcctgctatggcgggttatgacaaagatttgtgcgaatggtctatgactgcggatcagactgaagttgaaactcaaattgaagcagatattatgaatatcgttgaacgtgatcgtcctgaaatgaaagctgaagtgcaaaaacagcttaagtctggtggtgtaatgcagtataattatgttctgtattgcgataaaaactttaataataaaaatatcatcgctgaagtggtaggtgaataatgctttatcaaatgcacaagtgtaaagacacgtacaaatataaaggtgcccagtgttatatcattaatcgtgaaaacgcaggtccaggccattcgcatcaatcacggtttgtattcgttaaaaataatgaaattatagcagttgctaattatatgcttgtgaccaatgatgttaatccggtgcctttcacatatgacaatctaatggacttggcatatgattataattggtttaatcatgacaatttagttcatattgaaggcgtaggatttgacatctcttattctagttattcgttgtgccctatgagccgagctcataaagagcctgaatatttttcatttcgtcggcgtgtagactttaaacgcagtacagagtatgtcggtggaatctttgttaaagataatcgaattactcgcattatttatcctttgggctttggtcaaaaagatattgatgttgatttagactttactgaaagcagcattaatcatattgcttctgtgtattttgatattgatcacaaaattgtaatatgtggatatgaattaccatccgaaaaacagtctaaagtaaatgtttctattgatgaccaaatttttaatgcttttatgaatagaggttaatatgaaaacatttaaagaatttattaaagaagatatggtcgctggagattcaggtggtaatcctgaaaatatctctactggaacaacatcaggcgctgtagtaaataaaggtcctgaacagattcctaaaaagaaaaaagaggaatctaaagaaaaagaagagtaaaaatgtcatcaataccttggattgataatgagtttgcgtatcgtgcattagctcatttacctaaattcacacaagtaaataatagttcaacttttaaattacggtttagatgcccagtgtgtggagattcaaaaaccgaccaaaataaagcccgtggatggtattatggtgataataatgaaggaaatattcattgttataactgtaactatcatgcaccaatcggaatatatttaaaggagtttgaacctgatttatatcgtgagtatatctttgaaataagaaaagaaaaaggtaaaagtcgtccagtagaaaaacctaaagaacttcctaaacaacctgagaagaaaataattaaatctcttccgtcatgcgttagattagataaactggcggaagaccatccaattataaaatatgtaaaagctcgttgtattccaaatgataaatggaaatatctttggtttacaaccgaatggcctaaattagttaatagcatagcaccaggaacatacaaaaaggaaatttctgagcctcgtcttgttattccaatttataatgctaatggaaaagctgagtcttttcaaggacgtgcattaaagaaagatgctcctcaaaaatatatcaccattaaagcttatcctgaggcaacaaaaatatatggagtcgaacgagttaaagatggtgatgtatatgttctagaaggacctatagattcactttttattgaaaatggtatagctattacgggtggtcaattagacctagaagttgttccatttaaagatagacgagtgtgggttttagataatgaacctcgtcaccctgacactatcaaacgaatgactaaattagttgatgcaggagaaagagttatgttttgggataaatctccctggaaatcaaaagatgttaatgatatgattagaaaggaaggtgcaacccctgaacaaattatggaatatatgaaaaataatattgcccaagggttgatggctaaaatgcggttatctaaatatgccaagatttaaattaacccaactaaagcaaatgctagatctacgaatgtatcaagagtaattactggaatattaacaccatgagcaatagcaattggtgataaaacaaaattccagagtaaaattcctaccatagcagaaatagtaaaagctatacgttttttattaccttttatggcattaacaagtgccattaatttttgtgccatatgtcctcctttaaattaatatttatcacaaatttcataaatttgtttactttctcagcttgttatggtattataaaataaattgctgaggatgatataatgattaataaaattgtgcatgaaatggctttaaacggagattcatataaaatatctgccgtagttgaaaatttcatacttaataaagtaaaagaatatttcactgattgttcagttagttatcaagaaaaaatggttttaaccgatgatactgaaaaatcaaataatttgttttgttctaattttataactaagaagcgtactagaagatttgatattgttatttctcgcaacggtaaaaagcatataattgaaattaaacaccaagttggtggagatacagctattgattcggttggaatatatttagaagataaagagaaattaaaagaatacacaaaaactgaaaaccctgtgtcattgatgatattagattttttgccatgcggatattatccacgtaataaatggacaaaaagagaatcatttactgataatccaaccatccaagcaagatttaatgaatatgctaaatcacaaaacgtgttagtattactatcaaatacatatgatgaagaattatataattcgttttttgctgcaataaatgagagaatataatgctaggagctatcgcgtatacaggtaataaacagtcattattacctgaacttaagcctcattttccaaaatatgacagattcgtggatttattttgtggaggtttatcagtgtctttgaacgtcaatggtcctgtattggccaatgatattcaagaaccaattattgaaatgtataagcgtcttattaatgtatcatgggatgacgttttaaaagtaataaagcaatacaaactatcaaaaacatcaaaagaagagtttttgaaattacgtgaagattataataaaactagagatcctcttttactttatgttcttcattttcacggatttagtaatatgattcgtataaacgataaaggaaattttactactccgtttggaaaaagaactataaacaaaaatagtgaaaaacgctttaatcactttaagcaaaattgtgataaaataatctttagttcattgcattttaaagatgtcaaaattctagacggcgattttgtatatgtggaccctccatatcttataacagttgctgattataataaattttggtcagaagaagaagaaaaagaccttttaaatcttttagattctttaaatgacagaggaataaaatttggactgtcgaatgttttagagcatcacggaaaggaaaacactcttcttaaagaatggtctaaaaaatataatgttaagcatcttaataaaaaatacgtctttaacatatatcattccaaagaaaagaatggaactgatgaagtatatatttttaattaattgcttacatactcaaatgatataattatttaacttattaatgaattgaaaggaaaaataatggcttactttaacgaatgtagtcaactgatcgaaggcgctgataaagctcaaaatgaatactgggatattctcggtgatgaaaaagacccgctgcaagttatgcttgatatgcagaaatctttgcaggttcgtttagctaaagataaacctgaatataaccgtcatcctgatgatttggctactgcaggcgaagttgtcgattggctgcgtaatcagaaagattacattgatgatgaattccgcgaactattgacttctcttggtggtatgagcaatggtgaaaaagatgcatctgctgtatggaagccttggaagtcgcagcatggtgaacgtcgtgaaactctaattactgatttgtcaccacaagaccaattggaaattaaattcgaaatgattgatattcttcatttcgttctgaacatgttccaaggtctcggtcttacggctgaagaaatctttaaactttattatctgaaaaatgctgaaaacttcgctcgtcaagaccgaggttattaatggctcgtttaaataaacgccagcttaagaaagcccacaagaaacgtattgaccagctatttaaaaattatgacaaggagctcacatacgagctcctatctaatcagctccacaaagcttacacaattaaaactggacatatacaattaggtaaggtgcatgaagaagccttaaaattaattatagagcattcaaaatgaaatttgatttttatgcatggcaaaaagccgggagaccggctttttgagcatttggttctgatggatataatattagagctcattggaagtttaatgctccagccgattattctccggtaattattaacggtgatgttgttatattaactaaaattgggtattttaacgttccgcaagaatttattataaatagtcatgtaatttaaataaaggagaattacatgactagtactcgcggttatgttaatattaaaacatttgagcaaaaattagatggaaataagaaaattgaaggaaaggaaatttctgtagctttccctctttattctgacgttcacaaaatttctggcgctcattatcagatattcccttcagaaaaagcagcatattctacagtatatgaagaaaatcaacgtactgaatggattactgcaaacgaagatttgtggaaagtaactggtgaataaattcaaggactccttcgggagtccttttttcattttaccggtttactttccaaaatgagtatggtataataaaattatcttatagaggagagcactatgttaaatcgctggattaaaccaaatgaagacctccagaaggttcttgataaagctatctctgataaatggggtatgaaaagctgggattgtgatatcgtcacgcattcattcatgatgcatgcagatggttcagtcgagttcaatgctgaaatgcgatacactgattggggtggatttcaaagagtcgaatttcaaagaggctttttgtaatgtttatctttaattggtttaaaagtttctttacggattttttctctacaactcccggagaaggtgtagttcctatttcaaatgactaccttcctttaactgtagttgaatatgtttatatgggagatggaacagtagaagcggttactatgacttatgaagaagcccaggaatattataaaaatccttggcgttggtcaacacctacatcatctaatacgcagaatacacagtctagttctgattcatatgatactaatgttcctgttcatgtgtggacgggcgattcatgtggaagttcttgtgattctagttgttcatctacatcttgtgattgaggaaaattatggaagcgattttgtttgaaatgtatattagcagtaatagtttgtcatttgctaaagatgttccaattactgtagcagtaatgattgataagggttattgtgacccaatgtatctcgtagaaaatttcgtttcaatgccagttccagaagatgctgaaataaaacttaaaaagattggtattattgaaactgtaccaaatattccatttagagcaattgaagcatttactaaatccgaatacattaatgttagcgcagaacaatataatgataagcctttatctttttattcgtacgattcactatatagttggaaaatagataaaggaaataaatttataattgcaagtgaagatgcgttatcatactttatttcttctgtatggaatagtttacatccaaatttgctaaaaattcatgaatttgatgatgctcctactgttgttttaggtaaaacaaatgaaagttctgaagaaaatgtttgaatggttcaatagaccaaactcaatgtatattgatgatggctgggttgaacaagcaaataaagaaatgcagaacgaatcggaagaatggatgaaatcaatgattagtgctgagaaagaaaagaaattagaacgctcagcgcttaaattgatgagagacatctatggtgataaatcatgaacaaagatatgacgttagaagaggccaaggctaaagcaaatgaagcactggatttgcttcttaaaattggcagtaaaatgatggaagaaaatgagaaatatatccaggaaaacaaaattcctgacggcccattagtaggcaaaaggaaatcacatgattgaagtagcaaaacattattcaatagaatttatgtctaaagaaggtaaatcagtaaatgcacttgataaaaaatgctcattaattattcctttagcagaaaatccggatcttttaattaaagatataaaagaaagaaaatatccagaaaatgttattctaattataaagcatactgaagatattttacagaatactgattcaccgttttcttcttctgaagctttaactattaaaggctataaaagagctcatgaatatggtctttttgccctgtttgaagacgataaagttaaattagcacttaatttagcaggtcaaccttctaaaagtaaaacattcattattgaagatattaaagatataaatgcatttgttaagatggtctgggctcattttgatgttggactacgctggagaatgtccgaagaagaaagaaagattattgaagctaatcgtcattttggtttttatcgctaggaattaatatggatttatttgagatgttagaagataatcattctacgaataaccagaatgattctagtgattataagaaagagtaccgtatagtattacagaattatggaattgaagccccagatgctcttctagaagaactagcttcataccatcttgaccctccgccctgggctccctgggcaaaataattcaaaaagttgtttactttcctttctaacgatgatatgatagcttctgaagtatacgggaggctatcatgattattaatctcgcagatgttgaacagttatctataaaagctgaaagcgttgattttcaatatgatatgtataaaaaggtctgtgaaaaatttactgactttgaacagtcaattctttggcaatgtatggaagccaaaaagaatgaagctcttcataggcagttgaataaaatcgttaaaaagcatttaactaaatcgccttatcagctatatcgtggtatatcaaaatcgacaaaagaactcattaaagatttacaagtcggagaagtgttttcaacgaacagagtagattcatttactactagtttgcacacagcatgtggtttttcttatgttgagtatttcactgaaataatatttcgcttaaaaactgataaagcttttaattattctgaccatatcagcgatattatactttcttctcctaatactgaatttaagtatacatatgaagatactgatggattagattcagagcgtactgataacttaatgatgattgtgcgtgaacaagaatggatgattccaattggaaagtatagaataacttctatttcaaaagaaaaattacacgattcatttggaacatttaaagtttatgatattgaggtagttgaatgaaatattcagcaatgcaattaaaagattttaaaatcaaatcaatggatgcatctgtgcgtgcttctattcgtgaagaattactttctgaaggatttaatttatctgaaattgaacttttaattcattgtattactaataaaccagacgatcattcttggttaaatgaaatagtcaaatctcgtttggaaccaaacgataaacctctttggagaggtgttccagctgagactaagcaggtgttaaatcaaggaattgatattattacatttgataaagtcgtatcagcttcatatgataaaaatatagctctacattttgcttctggattagaatacaacacacaagttatttttgaattcaaagctcctatggtgtttaatttccaggagtatgctataaaagctttacgttgtaaagaatatagtccgagttttaagtttccggatagccatcgctatcgtaatatggaattagtttcagatgaacaagaagtaatgataccagctggaagtgtatttagaattgcggatagatacgagtataaaaagtattcaacatacactatctatactcttgattttgaaggatttaatctataatggaaggacttagattcattataccatgaaagttttaaagcatttttcataaagttgtttacaagctgaagtaaaaatgttatagtataagtagttaacccgtccgtgagaaaaatatgaaactgtctaaaaatcaaattcgtaaaattacacgtcgtctagagcatactcaggcatctgctaaaagacgttctaaagattttaacttagacttcaattacattaagaacattttagatcagaaagtttgcgcttactcaggagaaccttttgataatcgtattgaaggagagaaattatcattagaacgttttgataataacgttggatacattaaagggaatgttattgcagtaaagaaaaagtacaatacatttcgttctgattatactttagaagagttgattgaaaagcgtgatttatttgctttgcgaattggtcgttcatctgcgaaaaaagttcataaactaaatttagatgaaaagaaatgggctaaaatcaaaaagacttataatcaaattaaagctatacagaaaaaacgtgaaaaccgaattgaacacatttctcagctttctaaatcaaaacagacctctgacattaagctaaggattatagcacttaaagcacgtattgatggttctcgcatagcagaaggcgctgaagttgttaaattgaacgttcttcttaaaggctcggattggaaaattgtgaaaaagctgtcagaagcagaaatgcaatatgatatgtgtgataaaattattcaaggtgtagagcggtatcaaaatttgtcttttattgataaacttaaactgaaaagaggatacccgctaaattgttcaatttttaaacttatccgaggataatatggtttatgtatatgcgatagtttaccgagacaaagacggatttacggcgccagttccacttgatgaacatcgtcctgctgtattttttgaaagggagattgctgataaagtatttactactcttaaagagcagtatcgactagctttaggtaaaggaattccaagattagttgagactccacgtaaattttggtttaataaaatagaagttaaacatgttaagcctgatgtagatacacaaagattatatcaacgaattctagatactgggcgtattgttagtattccaattgcagggactttccgatgacatttgatgatttgacagaaggccagaaaaatgcctttaacatcgttatgagggctattaaagaaaagaaacatcatgtaactattaatggacctgctggtaccggtaagactactcttactaagttcatcattgaagctttaatatctacgggtgaaactggtattattttagcagctcctactcatgcagctaaaaagattctttcaaaactatcagggaaagaagcaagtactattcatagcattcttaaaattaacccagtaacatatgaagaaaacgttctttttgaacaaaaagaagtaccggatttagctaaatgcagagtattaatctgcgacgaagtgtcaatgtatgatagaaagctatttaaaattctgctttcaactatcccgccgtggtgtactataattggaataggtgataataagcagattagacctgttgacccaggagaaaacactgcttatatcagtccattctttacacacaaagatttttatcagtgtgaacttactgaagttaaacgcagtaatgctcctattattgatgtagctactgacgttcgtaacggtaagtggatttatgataaaattgttgacgggcatggagtacgtggatttacaggtgataccgctttacgcgattttatggtaaattatttttcaatcgtaaaatcactagatgatttgtttgaaaatcgcgtaatggcatttacgaataaatctgttgacaagttaaatagcattattcgtaaaaagatttttgaaactgataaagattttattgtcggtgaaattattgtaatgcaggaaccattaattaaaacatataaaattgatggaaagcctgtgccagaaattatttttaataacggacaattagttcgtattatagaagcagagtatacatcgacgtttgttaaagctcgtggtgttcctggagaatacttaattcgtcattgggatttaacagtagaaacttatggcgatgatgaatattatcgtgaaaagattaaaataatttcatctgatgaagaactgtataagtttaacctatttttaggtaaaacggcagaaacttataaaaattggaacaaaggcggaaaagctccatggagtgatttttgggatgctaaatcacagtttagtaaagtgaaagcacttcctgcatcaacattccataaagcacagggcatgtctgtagaccgtgctttcatttatacgccttgtattcattatgcagatgctgaattggctcaacaacttctttatgttggtgttacccgtggtcgttatgatgtgttttatgtatgattaaatttgaggaagctattcgtggaaataactaaagatcagttttatcttcttcaagataaagtaagcgaaatttatgaaattgcttatagcaaaaatcgtgaaactgtaaaaatagaatctagtaagttgatgcttcaattagaagaaattgaacgagatttaattgcgttagaattcttttgtggtgaagtgaaaactgttacaatcaatgattatattttaggcgaaattagctatctttataaggcgattattaatgattgaattgagttggtaccagtttaaatctcttatgacaaatgttaaaactgtcattgaagaaaatcagggtcctgaaaatattactattcgcgaaaaagctttaaagatagtatacagtcttgaagaaatacaaaaagatattgaatctatggcaaaatttattgatgaacctattaataaagtttatattcaagattatactgtaggtcaaattcgcgatttagcaaggaaaatttaatgtttgattttattatagattttgaaacaatgggaagtggtgaaaaagcagctgttattgatttagctgtaattgcttttgaccctaatccagaagtagttgaaacatttgatgaattagtttcacgcggcattaaaatcaagtttgatttaaaaagccaaaaaggacatcgtctttttactaaaagcactatcgaatggtggaagaatcaatctcctgaagctcgaaaaaatattgcaccatcagatgaagatgtaagcactatcgatggtattgcaaaatttaatgattacatcaatgcacataatatcgatccttggaaatctcaaggctggtgccgtggaatgtcgtttgattttccaattttagtcgatcttattcgtgatattcaacgttttaatggtgtttctgagaatgagcttgacacatttaagttagaaccatgtaaattctggaatcagcgtgatattcgtaccagaattgaagcacttctgcttgttcgtgatatgaccacgtgtcctcttccaaaaggaactttagatggattcgttgcgcatgattctattcatgactgtgcgaaagacatcctgatgatgaagtacgctttgcgatatgctatgggtcttgaagatgctccatcagaggaagattgcgatcctctatctcttccaacaaaacgataaaaagttgtttacttcctcggttagttgtggtattataacaccatagctactgaggataataaaatgaaaatttatcgtgttgaatcatcgtttagtattcttgattatgaagatgctataacaatacgtcgaaatctttgtgttcaaataacgccgtacaggagtataatagattcatggagcgaagagtggctattacacgtaggttatgacagacctaattttatgcatcatagcgataataataaaagaattcctttaccacacgaagataaactattagttaaaaacgctaatatagtaattaatactaagttcaagaaagattatgttggagtagaatatcatattccaggatggtttataggtctttatcattttgctttcgctagtgaatatgatatgatgagatggttcacacgagaagagcgtgaagaattagcttcgaaaggattttatcttgctgtatacgaagtaccagatgaccaagttatcattggcgggcatcaagtaatgttccgtaaatcccatgctgaacttgtagattttattgaaatgagataattatgaaatttaattataatcctgaatacacaccgaatccggcagctaaactgattgattttgacgttgtaagtacttatgtatgccctgttaaaccactggaaattaaggaacctactatgactaccgctattgaaatcggcaaaacctacaaactggttgaacctaaaattaaaactaatgccttgatttctggtcataaaactctgactgatgtttttggcgaaggcgaatttattgttgaagaatttgccaaaagtgagtggtttgacaaatcttacgtcatccacggtcgccggttagataataacaaaataaagaaaaacctggtttatgaagatgagttcatcctgttccaagaagttgaagaacaagaccctacagacctgttgtgtgctgctgtgtctatccgtcgtccttttgataatcctatctgtggttgggtaacagaccagtggattgaagatggtgttgagcttctgaacgttgtccatgcaggagattttagtgtagtacctcgtagtgcggtggtagctattttgaattaatagtttacaaactcttgggaccagagtataatggtcctgtggagtataaaatctttttaacaagtgagagataactatgattattaatattggtgaaattgctcgtgtatctgataaatcccgttctaaagcagcaggaaaattggtcgaaattgtaagcattcagcttaaacacggcgttaaagatgaagattctgaagtaaaagtgcgtatcattcctaaagatggaaagtctaaacctcagtttggttatgttcgcgcgaaatttcttgaatctgcgtttttgaaagctgttcccgctaaaggaattgaaacgattgatacttcgcatgtaggtgtagactttaagtggaaactcggtcaagctattaagttcattgctccttatgagtttgaatttatcgaaggtggacaaccacttcctcggcgtactcgcgctatgtgcgcatacattactgatcaatgggtagaagatggcgttaagttatacaacgcggtatttttaggaacatacaaagtcattcctgaaagttggattaaacactacagcaaagctcgctatgcataaagtttaaaattttttcataaaactatatacatcagtagttgattatggtactatatcaatatcaactactgatacagaaaacaacttggagaataaaatggataattcgttaaaggtgcgctgatactcttctgaaacgcatcgctccaatgttcaattaatgaggaaattatgatgaaacgtaaaattattcagaattgcactaatgatgaatttgaagatgtgttattcgatccagatttggtagtagttcaaaaggaacacactgctaagtttactcacttgacttcggtttatgtgtatgaaaaggttggggataaacaaccaatttacggtgtatttcgtgaaatcactgaagatggtacaacttactggaaggaaatttattaatggctattaaatttgaagttaataaatggtatcaatttaaaaataaacaagctcaagaaaattttattaaagaccatactgataacggaatctatgcacgccgtttaggtatgcatccttttaaaattttagatgtggatgctcttgggcgtcctattaaaattatgtcatttgctggaaatttagtactatcttctggtaaagatattttggatgaagattttatttggctttcatcgaatgaagctgaattctttaatgaagttgaaaatccataccaggcagctgaagagcaggaagaatctgcaccgataattgatcaatctaaattccctgtaatgaaagttactattgaaaatgatgaacaggcatggtccttgtatcagatgttgaaagctcactttaaggaataattatgccgctttatgattataaatgtcaatcaaaagactgcgcaaaagaatacgaaaaaatcaagaaaatttctgaaagagatactgatgtatgtcctgattgtcatcggattgctgttcggttagtttccgctcctagacatgtgaatggtggtttttacgacttgcttaaagggtgattatgtttaaaatcggtaagaaatatcgcattcgcgaaggtgaagaaaagaaatatctattttctgctatttataggaatggttctattagtaatgtaatatctacaagcgaatttatcgttgaagatatgaaaggtaataacgttacaatgattagtacagcatctggaaatgacggaaaaattcttcacagttttcagagtaatgttctaatatatgatgaagaatttaatctattcgaagaagttcccgaagattttgattttgaatgcactatcactatgaaatctggtgaccctctttcttttacagttaaagatgaaagaagccgcttgagagttattagtcttcttcaagccattaaatttaagtgaaaattatgaaatatattaatcgttctatcgcagcattagtattagcagtgtctttaataggatgtactgatgctgataatgcaaccaaagttttgtcttcaagtggttttactaatattgaaatcactggatataattggttcggttgctctgaaaatgatttccagcatactggatttcgtgctattggacctactgggcagaaagtagaaggaacagtatgttctggactattcttcaaggattcgactattcgttttaaataaaaggccttcgggcctttagctttatgattaccggagtataatattcccgaaaccaaacgaggataagtgatgattaagaatgaaattaaaattctgagcgatattgaacatatcaaaaagcgtagcggcatgtatattggctcttctgctaatgaaatgcatgagcgctttctgtttggtaaatgggaaagtgttcagtatgtacctggtcttgttaagcttattgatgaaattatcgataactcagtagatgaaggtattcgtactaagtttaaattcgcaaataaaattaatgttactattaaaaacaatcaagtaacagttgaagataacggtcgcggtattccacaagcgatggtcaaaacacctaccggtgaagaaattcctggtcctgttgctgcatggactattccaaaagcaggtggtaactttggtgatgataaagaacgtgtcaccggtggtatgaatggtgttggttctagtttgacaaacattttttctgtgatgtttgtcggtgaaactggtgatggtcaaaataatattgtagttcgttgttcaaatggcatggaaaataaatcatgggaagatattcctggaaaatggaaaggaactcgtgttactttcattcctgattttatgtcatttgaaactaatgagctgtctcaggtttatcttgacattacactggaccgtctccagacactcgcagtagtttatcctgatattcaatttacctttaatggtaaaaaggttcagggcaattttaagaaatatgcacgccaatatgatgagcatgctattgttcaagaacaagaaaattgttctattgcggttggtcgttcaccggatggttttcgtcaattaacatacgttaataacattcatactaagaatggtggccatcacattgactgtgttatggatgatatttgtgaagaccttattccacaaatcaaacgtaagttcaaaattgatgtgactaaagcacgcgttaaagaatgtttgactatcgttatgtttgtccgtgatatgaaaaacatgcgatttgattctcaaactaaagagcgtttgacttctccatttggtgaaatccgtagtcatattcaacttgatgctaaaaagatttcacgtgctattctaaataatgaagcaattctaatgccgattattgaagctgctttggctcgtaaattggcggcagaaaaagcagcagaaactaaagcagctaaaaaggcttctaaagctaaggttcataaacatatcaaagcgaatctttgtggtaaagatgctgacactactcttttcttgactgagggtgattcggctatcggatatcttattgatgttcgtgataaagaacttcatggtggttatccattgcgcggtaaagttctcaacagttggggtatgtcatatgctgatatgcttaaaaacaaagaattgtttgatatttgcgcaatcactggattagttctcggtgaaaaagctgaaaacttgaattatcataatatcgctattatgactgatgctgaccatgatggtctaggaagcatttatccttctctgctcgggttttttagtaattggccagaactgtttgagcaaggaagaattcgttttgtcaaaactcctgtaatcatcgctcaggtcggtaaaaaacaagaatggttttatacagtcgctgaatatgagagtgctaaagatgctctacctaaacatagcatccgttatattaaaggacttggctctttggaaaaatctgaatatcgtgagatgattcaaaatccagtatatgatgttgttaaacttcctgagaactggaaagagctttttgaaatgctcatgggagataatgctgaccttcgtaaagaatggatgagccagtagtttactttaccacaaggatgtggtataattaattgggcaaatgaggatattgaaatgaaatcatataaagtaaatttagaactttttgataaagcagttcatcgagaatatagaatcattcaacgctttttcgatatgggagaagccgaagaatttaaaaaccgctttaaagatattagagataaaattcaatccgacactgcaactaaagatgaattactagaagttgctgaagttattaagcgtaatatgaattaatgaggaaattatgattatcaccactgaaaaagaaacaattcttggcaatggttctaaatcaaaagcatttagcatcacagcatctcctaaagtatttaaaattctgtcatctgatttgtatacaaacaagattcgtgcagtagtccgtgaattaattactaatatgattgatgcccatgcacttaatggaaatcctgaaaaatttatcatacaagttccaggacgattagatccgcgatttgtttgtcgagattttggtccgggtatgagtgattttgatattcagggtgatgataattctcctgggttatataattcatacttcagttcatctaaggctgaatctaatgactttattggcgggtttggtttaggttctaaatctccgtttagttatactgatacatttagtattacttcgtatcataaaggtgaaattcgtggttatgtagcttacatggatggtgatggtccacagattaaacctacattcgtaaaagaaatgggtccagatgataaaactggtattgaaatcgtagttccagttgaagaaaaagactttagaaactttgcttatgaagtttcttatatcatgcgaccattcaaagatttggctatcattaatggtcttgaccgcgaaattgattattttccggattttgatgactattacggtgtaaatccagaaagatactggcctgatcgtggtggattatatgctatctatggcggtattgtttatcctatcgatggtgttattagagaccgtaactggctaagcattcgcaatgaagtgaattacattaagtttccaatgggttcacttgatattgctccatctcgcgaggctctttcactggatgatcgtactcgtaaaaatattattgaacgagttaaagaactcagtgagaaagcatttaatgaagatgtaaaacgatttaaagaatccacatctccccgtcatacatatcgtgaattgatgaagatgggatattctgctcgagattatatgattagtaattcagtcaaatttacgactaaaaatctgtcatataagaagatgcaaagcatgtttgaacctgatagtaagttatgcaatgcaggagttgtgtatgaagtaaatcttgaccctcgactgaagcgcattaagcaaagtcatgaaacttcagccgttgcatcaagttatcgtctgtttggtattaatgcaacaaaaattaatatcgttattgataatattaaaaatcgtgttaatattgtccgtggattagcacatgcgttagatgatagtgaatttaataacactttgaatattcatcacaacgaacgccttctgtttattaatccagaagtagaatcgcagattgatttgcttcctgatattatggcgatgtttgaaagtgatgaagttaacattcattatttgtcagaaatcgaagctttagttaaaagctatattccaaaggtagttaaaagtaaagctcctcgtcctaaagctgctacagcatttaagtttgaaattaaagacgggcgctgggaaaaagaggaattatttacgctcacatcagaagcagatgaaattactgggtatgtagcgtatatgcatcgttctgatattttctctatggatggtactacatctctttgtcatccatctatgaatattttgattcgtatggctaatcttattggcattaatgagttttatgttattcgtccgcttttgcagaaaaaggtaaaagaactcggtcagtgccaatgtatttttgaaactctgcgtgatttatatgtagatgcttttgatgatgtagattatgataagtacgtaggttattcaagttcagctcaacgatatattgataaaattatcaagtatcctgaactagattttatgatgaagtacttcagtacagatgaagtttctgaagaatatacacgactcgctaatatagttagttcattgcgcggtgtatattttaatggtggaaaagataccatcggtcatgacatctggacagtaactaatctctttgatgaattatcacgtaatgcttcaaaaaatagtgataaaatggttgctgagtttaccaagaaattccgtattgtttccgacttcatcggttatcgtaactctttgagtgatgatgaagtttcccaaatcgctaaaactatgaaggcccttgcggcctaataaggaaaattatgtacaatattaaatgcctgaccaaaaacgaacaagctgaaattgttaagctgtattcaagtggtaattacacccaacaggaattggctgattggcaaggtgtatcggttgacacaatccgtcgtgttttgaaaaatgctgaagaagctaaacgctctaaagttactattagcggtgatattacagttaaagttaatagcgatgtagctattgctccagttgctaaatctgacattatttggaatgcatctaaaaaattcatttcaattactgttgacggtgtaacttataacgcaactcctaatactcattcaaacttccaggaaattcttaatctgcttgtagcggataagttggaagaagcggcacaaaaaattaatgttcgtcgcgctgttgaaaaatatatttctggtgatgttcgaattgaaggcggaagcttgttctatcaaaatatcgaattacggtctggtctggttgatcgtattctcgattcgatggaaaaaggtgaaaactttgaattttattttccgttcttggaaaatctgctggaaaacccaagccaaaaagcggtatctcgactctttgatttcttggtagcaaatgatattgaaattacagaagatggttacttctatgcttggaaagtagttcgtgacaactactttgactgtcactcaaacacctttgataacagtccgggtaaagtagttaaaatgccacgtactcgtgtgaatgacgatgatacacaaacttgttctcgtggtctgcatgtgtgttctaaatcttatattcgtcactttggcagttcaactagtcgagttgtaaaagttaaagtacatccgcgtgatgtagtatcaattccgattgattacaacgatgctaaaatgcgtacctgccaatacgaagtagttgaagacgttactgaacaatttaaataagggcttcggcccttaactaaggaaaattatgttaggttatcaagcacgagtaaaagaagaatacgatcaattaatgctcaaaattaatgcactgagcaaatttttagaaagcgcaaagtttctaacagttaatgcagttgagcaagaactgttactttcgcagtttatctcaatgaaatcttatgctgaatgtctagagaaaagaattgcacaattcaaataaaataagggcttcggcccttttgttttaagagaaattatgatttattatatgaatactagtgattcagacataaaaggaaagtttaaatgcagaaaacgaatccggggttacagagactatttcagattccgacatttaccctatcgaacagtgacttgactagtgaaatgaaggtcaaaattgttgatactgcaagatactctttaaaacaaaacccaaatcaggataaggcagaagttatcgaaagatgccgtatcgctgtgtacgcagagttttttgtagcagattggctgagcgggtatgttaacaaaggtcaagaagatgtcgatgatccgtacacatatgcatgggatgtattggcgcatccaagatactgcgggcttcgtgtagaagttaagacacatcaaactgactcacgttggatttcggtgacaacaggatgcagtggagagtatccatatggttctggaataaatctagggcccattctaaatcatcaagtcgctgactgtataattatattcaacactaaagaaattcatccaggtgtcatccaatacactccgaagttcatcggtgatagagaagaccttcgtaaggttgtaagaaaaagcaactacagcggatggtatctttccatttaaaaaatttcacaaaatggtttacataccacaaggaccgtggtactatacaactatcaactgatacggatttggagagtaaaatgaaatttaaattttattatgctaagcataaaataactgatgagtttgtgtcagttgaatattctagcgatgatgaaggcatgatttatactcgcttaggattatcgcattgggagtccgatcagccttatttttcaactcctgaagaaattacacgcttagttaatggtcatatgaatgaccactggaatgtaattctttcagatagtcttaaagaggctattaatagtaatgaaatgaaaatcgttgagattgaactatgagttcattatggtggtgttttgtttggttaattagtattccagtaatttgtttaacatttacttttgtgatgaggttattatgaaaattttgaattctgtacttattgcttgtgcgtggtgggttgcacaggtttcagcggtagtagttggtattcacatttattacgaatatttttaaaaaagttgtttacaagactgttcttccgtggtactattaccctatcaactacggaggaacagaaaatgaaaaagattattaaagctatatggaatgtagttataatactaatagttttgagtatattcccaatcgttttaatgattgatgtattaaacgtttactttggatttatgtgaggaaaatatgaaacgtaaacgcaatgcttttacatttattgaatggtttttcgataatatttttccggctttattcattttcatgctgatttttgccttaggttcagttgtagttggaatctatttgatgacagtagtcggaattgatattcatcaaaatggtttaaaatccgtagttgaaacaatttggaatggtgtaaaatgatgaatttgctgagcggttggttttatattctcatgttttacattggtgcaaatttcccatattggatgggatggtcaacaactgcattcggattttatattccttgaggtgaattatgaaaatttttaaagatgtaaaagttggtgaaattttttgtttagataacggtgatcagttaattcgtatttcacctcttaagagcactagcgagaaaccgacagttaatgctactttagcaaataacagtaatgaacgtttctgtattgaaaatgatactgaaacttataccgtagaagagttttgggaattgagcgtcgactgcgacgattaatttaatggccgcgtattcatgcggccttggagtagaaaataatttagaggaaattaatatgaaatacatgactgttactgatctgaataatgcaggcgctactgttattggtacaatcaagggtggtgagtggtttttgggaactccgcataaagatattttatctaaacctggattttattttttagtaagtaaattaaatggtcgtccatttagtaatccatgtgtgtctgcacgattttatgtaggtaatcagcgttctaagcaaggattcagtgcagttctaagtcatattcgtcaacgtcggtctcagcttgcacgtactattgcaaataacaatatggtatacacagtattttatctgcctgcttctaagatgaaacctctgacgacgggatttggaaaaggacagttagctttagcgtttactcgtaatcatcattctgagtatcaaacacttgaagaaatgaaccgtatgttggctgataattttaaattcgttttgcaggcatattaatgagtaatttccacaacgaacacgtgatgcagttctatcgtaataatcttaaaactaaaggcgtcttcggacgccagtgaggaaaatatgaatatcgcaaaattattaggagttatttcatttatttgttggatagtagcatgtgttttaactatctgtatcgatgctagcagtgtgttttcacaagctttagcccagggtatgtgtgcatatttaacatttgtgttgttatctactaatgattaagaaaatcttgggctattcattagcccttgctattttattgatagcattatattacggaataatgttcggattaattcaagtcgtgcttttcatttctgatgttattatggcactacattcactagtatggtaaatttatgcaactgaataatcgtgatttaaaaagtatcattgataatgaagcattggcttatgctatgtacacggttgaaaatcgtgccattccaaatatgattgacggatttaagccagttcaacgatttgttattgctcgagctcttgatttggcacgaggaaataaagataagtttcacaaactcgcttctatcgcaggcggtgtagcggaccttggatatcatcatggtgaaaactctgcgcaagacgcaggtgctttgatggctaacacttggaataataactttcctctgttagacggtcaaggaaacttcggttctcgtactgtccaaaaggcagcagcaagtcgttatatttttgctcgtgtaagtaaaaatttctataacgtatataaagatactgaatatgctccggtacatcaagataaagaacacattccgcctgctttctatttgcctgttattcctactgttcttcttaatggcgtttccggtattgcaactggttatgcaacttacattcttcctcatagtgtttcttctgtcaagaaagctgtactgcaagctcttcaaggaaagaaagtaactaaaccgaaggtagaattcccagaatttcgtggtgaagtcgttgaaattgatgggcaatatgaaattcgtggaacatataagtttacttcacgaactcaaatgcatatcactgagattccatataagtatgatcgtgaaacttacgtgagtaaaatcttagacccacttgaagataaaggcttcattacatgggatgatgcttgtggtgagcatggctttggcttcaaagttaaattccgaaaagaatactctttgagcgataatgaagaagaacgccatgcaaaaattatgaaagacttcggactgattgagcgtcgttctcagaatattacagtcattaatgagaaaggaaagctgcaagtttacgataacgtagttgatttaatcaaagacttcgttgaagttcgtaaaacttatgtccaaaaacgaattgataacaaaatcaaagaaactgaatcagcatttcgtttagcttttgccaaggcacatttcattaagaaagtaatttcaggtgaaattgttgtacaaggtaaaactcgcaaagaactgaccgaagaactttctaaaattgatatgtattcttcttatgttgataaactagttggaatgaacatttttcatatgacttccgacgaagcaaagaaacttgctgaagaagctaaagccaaaaaagaagaaaacgaatattggaaaactactgatgtagttacagaatacaccaaagatttagaggaaatcaaatgagtccattcattggtatcacaagcgctgcattagtatctggtggcattttactggcgggtttaggtgttgttcctgccgtagcaggaggtcttcttgcgttcggaattcaacgtgttatcatgacagttatcacagtcatgcagtaattttagggagagccgaggctctcccttttttatttcaaaaattttttcacaaaacggtttacaaccaaagcatactgtggtactatacaactatcaaataaatgaactgaaacaaacaacccggagatacaaaaaatgaaatttaaaatcgaaaacgaaatcgttaaagctaaaaatgctctgactgctaacaaactggttgtagatggtattgaatatgatatctgtggagttcgtgaagaaaaacctggtgttctgactttcttcacaatgatttttaaatttaaaggtgacacagaattcaaacagtttgattttgcccatgaagacgaaatcgaagttcgtaatctgaacattaagtaagtactttattagagctcttgaaaaagagtgcaaaaaagtgtttacttctgctttaaacatgatactatagacctatcaaataaatgaactgaaacggagattaaaatgtctaaagtaacttacatcatcaaagcttctaacgatgttctgaatgaaaaaactgctgcgattttaattaccattgctaagaaagatttcattacagccgcagaagttcgtgaggtgcatccagatttaggtaatgcagtagttaatagtaatattggggtattgattaaaaaaggcctggtggagaaatctggtgatggattaatcattactggtgaagctcaggatattatttcaaatgcagcaactttatacgcacaggaaaacgctccggaactgctgaaaaaacgagcaactcgtaaagctcgtgagattacttctgatatggaagaagataaagacttcatgttaaaacttttagatgaaaatggatttgttcttaaaaaggttgaaacttaccgcagtaactatctcgctattttagaaaaacgcactcacggaattcgtaattttgaaattaacaacaatggaaatatgcgaatttttggatacaaaatgatggaacatcatattcagaaatttactgacatcggaatgtcatgtaaaatcgctaaaaacggtaatgtgtatcttgacattaaacgctcggcagaaaacattgaagctgtaatcactgtagcatctgaactgtgaggaataaataatgaacaagttagaaattgttaatgaacttcgtcgttgtgcagaacctactcaagagggttgggatatttggtaccatggagcttatcttggaactattgtaaagattaagactggtaaatacatgattattcgtgaaagtaaagatgctccagtaggtattcgcaataattttatggcagcgataagttcatttacggatgcagcttacgaaatttaccttgctgattataaagaattccaggaatctcaaccagttattcgttcaattggtgttaacaaagctcaacagaaaactttatggcaacgtattaaaggatggtttaaatgaaaacatttaaaattgtcgtagaattttataacggcgaaggtgtagtccatcttaaagcggccaaccagtttgatgcggtaagagtatattgtcaatgctttgaaagttctaaacaagctataaaaattaaaagtgttgaggaaaccaaatgaaaaccttcaaagagcgtcttgaattattagacctagctttattacgtgaaactccagaaagtctagcagctaaattacaggcctatggcgactacaccgaatatacggaagaggatgttttagaagaggttcctgaaatctgttggcaagtagctcattggaacaataatgaaaaatatcaacgtcgaattgtgtgtgcagccaaccgctttaagttaaaagatggtgggactctggttattcctggtgctcgtcattattctaaagatatggctgaagttcttgaccaggtaagtgataaacttgtatcagaccatgtttgtggtgaagaccaaggatttattgaccagtatagcaattactggacacgtgaagaagcaatgattattgcaacttacgctggacaagtgcgtattgaacgtggtggtagtgaaaaagaactttactctgaggacctttactaatgaatattaaaaagtttcaaattgatggaattaagaatcaaatccaggcgttggaatatgccaataaaatgatgtcaactaattggggaatttatgccaatgaaccggcatttcagttctgtgatatggaattcaccaaaaagctcgtaggaaaagattatgtatgtccatttagttctccagtaaatggaatgttaaaacctgctttacgcgatctttatattgcgatgaacgaagaaatgataaaagaactaaaacgtcaactgaaggtgattcaatttggccagggaaattaattcaaaatctgattattttaattctctcaatgataaagataaaaatctaataaggcattttattgttgagatgggatatactgatacacgtgatttaagagaacatatatttgaatgtggtgtagctaaaaagttttcattcacatgcaaatgtttaagagaggtaattcagcactatgaacaatttagtcgcaaagcataattttaataaagcttctgttcataaggataagaagaaagcgtttaaagaatctaatcgcaaacagaaacataaggggaaggtctatgattattgattctcagtctgtggttcaatacacaatcaaaattgatattctagaaaagctatataagtttctaccaaacctataccattcaattgtcaatgaattagttgaagagttacatcttgagaataatgatttcttgattggaacttataaagacctctcaaaagcaggatatttttacgtaattccagctccaggaaaaagtattgatgatgtattaaaaactataatgatttatgtccatgattacgaaattgaagattatttcgaatgagtcataatcttgaaatggtaatcgagcataatgtagctcaggaacgcgagtcgttcaaggaattcgtagaaaaaatttttgaagaaaataacacagaccagtttacaaatcaagcgtctgatgatattataacaaagtcaactaattgagtggtatagttaatgaataaaaacattgatacagttcgtgaaattattactgttgcatctattttgattaaattttccagagaagatattgttgagaatcgtgctaattttattgcatttcttaatgagattggagtaacgcatgaaggtagaaagttaaatcagaattcatttcgtaaaattgtttctgaattaactcaagaagataagaaaaccctcatcgatgaattcaacgagggttttgagggtgtatatcgatatctagaaatgtatacgaacaaataattatttagcccttcctaatattctggccgcctgagcacatattgattcaaggcggtcattacttatatgatcatttctataccagtacatggttatcgttccagcatagatattatccaaattaaaatatggacaactgtacatgtagtttatttcgggagtaggctttttagttggtaaaaaagcaaattttgagtcggaataataatgacgtccatttaaatgaactgcatattcatccatagttttatcaacaggatatcctccaagtgatttttcgcttattgttgaaggtaattttccttcgtatgctataatatcaacaaaatagtttaagtttttagggcggaaagaatataccgcactaaagtctgcctcagatgatatatgaactatctggagttgttccagggcgacagattcaaagcgtgcatttctttccttttcaataatttcgctgtatgtttcatactttgattgcttatagtactcaaagaaactatctcccctataccaaacaatcgccatcataaataaaagaattacgacagctacccgggaagcaagaacattcccggtagcgttatctttgaacaagcgatctagaacacccaacagaatatcagagggcgaaaatgatattctaggtgctgccatagaccctccttttaaggatatttattcaaattatactcttggaccatatattgctccaacgttttgccatgtcggcgtagaccctatgacggcataaccggcagctccgccatcgtattcatatccttgaccacgaatattacatctacctcccgctgaacctacttcaccgccgtttccaccattatatataccattcacggatcctgagccaggtgcagaaatagtaccgccagtcgcgcctgattgcatatcaatagatccgcctggcgcaccaaaaggacgaccgccaccgccgccaaaggtcaatctcattcgtgaaaaaggagaataatatccg

SEQ ID NO: 6 - DNA, 168195 bp, Escherichia phage
  source 1..168195: mol_type = genomic DNA; note = HP3.2
ccgccgccgccgccaccgccgcctgcaatagctccgccattattaattcttagtctcccaccaatatcgttttgaatacaatgacctccagctgaaccaggactattgctaccgccattaccgccacgtccatacatcgttacgccgtgtatattcaactgaacatattcattcggtgtatctccgtacatgaagaataaaggaacatctttagaatatgatactaaatcacctgtaatattaaacactataggtgcactacctgcctcaaaacatctatctcggaaccattgaccattgaagttatggtctgctccaagcgtgtgaataatttctcgtgagcgacctgcaaattgactcatccagcaaggaacacccaatcttaattgaccagccgcttgactcatccagcgctgtcctgtttcatttgcggctgaacttccaatccaaccaggaacaccaactactgccataatttatactccaaagggggcatttcccccttgttgttagaatttaaaatatttactaattttgcgagcaattttagtaaagaaaggagttttcaattctttaatttcttcactcatttcctgaatagccttaattaaaagagcattcacagcagagttagaaattgtcagaacatcagatccatcaacttcaactttagatacagcttccggtaattccttttcaaggtcctgagcaataataccaacttcacgtttaataacactacggtctttaatagacttaactttatcgtaaatataaactttcagtcgacatactttttcaagtgctccgttttctagctcttttttattaatcttaagacgaccatcggaacgaatatacacatcgttaaagttaccattaccaggagaatagaaagtaccgtcgtaatgaaattcaaataccgcgttagggtgtccagccgctggcgatgcctccgcagatccaacacgaataattgcttgcccccaattgttagggacacgacgaataccaagatcgacggcagttacaaacccttgattggtgattacacttcttcctttgagaatcggataataacaatcctgtgaaacataaccatgatcgacgaatattggtgcttctactcgccattggttgccccaatcacccggttgtctagcaatccatccagaaccgttaatgtgtacacgatcgcggttaacgttaaccattgcgatattttgtggatttagcgaaatctcaccattgtttgtgatatgtactgccgcctgagtagcatagctataaaatgctagcgaattatcagcaccacccttaccaatataccagttaccactcccgtctacgtcaccacgaatatgcaaagcattaccagcagttgttgataatacaatagaatcacccggacgtttaataatcaatctaccttcggattcaatttcaccaaaaaatttagtcttaattgcaccagtcgctaaagtacgttcagtggaaaaatgaacgcctttgctgtcttctaactgaataatgttatcgcgcgcattattactatcaccccaatgattaaaccggaaataatcacgtgattgcttaccacccgcttcaaacgtcagcgtacctttacttaaattaacatcaccgctaaaggtagcagcaagagaatcacgttctaattttaaaacgttagcaccactagtaccacctaaagtaacatcaccagttctcaattcataacggaaaggtctatttgtattatagtttccattttgatcatcttcgttggtggaaagaatataaagattctctccataagtacggaaaattgtaccaaaatttccggcatacatacggaatgcattagatgagcgaaatttaacttctgttttaaaagtggtagtgttattaaggttaacagtagagttaaaattggtaggagcaccgaagttaactgcgccattaaaatcttgttgagctgtccatgtgtggcgaccatcttcaagaacaacacggcggactgtgcaagttctatttccagaattaccgaacacacgaacgacaaaataacggtagtttgtctgggatacagtaccgcgccaaacctgaacagtacgccctgtgctagtgtgttcgctaggaccaacggaaaacataaccaggtttccgtcaatcgtcccccaatccatatttgctggcatattctttattttgttcaaaggaacactaaacatactaccagggacaaaatcaaaggtttgccaatctagctccgctaattgagttttaataccacccatacccaaagtaattggcaaagagtaagatgtatatacttcgttccatgtaccccacgcgccaccggtatatgcacgctcaaaaatacgatcgcgagtagttgcacccgttccggcagtagtaaatttttggaaaatagcaccaccagaagcacgctgtttaacttccagcaaaccaacaataacggctggtaaaccttcaccagtaggacagttaataacggcatcagtgcctaaaatgttatataacccaggagttttaaaatcattcagatctccaccatagaaagtcgctggtgtgccatgaccaacctgcttccattcctcccacttaggtgcactagcatcccatgcagcagcgagacaacgagtataaaccatacccatgcgggtagtataacgctgagttctcgtgtataaaccaccttcaaatatttctaaaaatccttgtgcggctgatccttcttctggataatggcgatcaaatgatgcgattgcgcttgaactgtttcgccataagccacaatgttctaattctcccaagctattaaggtcaatcgtttgtgaaagtggacgagttgacgcttgaacattacgccacacaccccatggaccattgacgccattccatttagcagataaggaacgaatatagacgttaccagatcttacagtataacgctgagtgccagcaaattggccggccacaaacacttctagtacacctacggcattttcttctgggaatttatttgctggttgcgcatttgttgaagtagatttcgaccaaacaccaagatattcttcaatgggcccatacgtatctaaattagcatcagtaggtaattcgccattattttttataaatgttgtgctattgacatttatgtcagatggagttaaggtaatgtcctttgacccatcaaaagatataccattaattttcctaggtgtttgcaatttagtagctgtgctagaatttccaattaaagttccagttatattttctgtaacctctaaagacccatttatagttcctccatattttaaacctaattctataacactacctgagtcatcttttgtgaaaattgttttatcttttaagtttatagccaattcaccttcggctaatactgaagcagcaggacgttgacctgcagttttgcttcttttaaattgtatttgttttaaagtagccataagtcctcttaataatagccgaaatcttgaacagaatccttaattacgatttggtcaaatcgtggaacgtgtgaaggttgagatgcaggattctgtgaaaaaaggtttggcgcagttaaatttcctgtcatagtgtctccagagcgtaataccctagagtttgcatttgctgtaacagtatttattgctccatcaacataatctttgcgagtaacatcagatgctgcggaaggagtagatgtaacagttaccgatggagccgttacagccctggtaaatgttgtcaaaccttctggcgtaatagtaatttgtccagtagtgatttcactacctgctggtctaaaactaataccgccagaagagccaccaactacaagagtattaccagtgccgccaccagaacgaattcggatgggggtttcattattacttaattgaagataactatttaccccgtaattaatagtaattggaccggtgtaagtaccaccattagctttagaaacgaaatcgttatcagctgcctgcggtttattatattctgaatatattttaaatgatttgtagagtacatcgtcaccggctgaattcaatggaaaatttccttgatgccaaatgacagatccacctacagttgaacctacttttaaatcagccattatatgcccctttattttaatattatttataaagaaaaagggaacccgaaggctccctcagtttaaacttctctaaattcttgcccaaacactttgccagttttagaagaggcttgtgtaggaagtaccattatatctggaggtgaagccgattcgcagacataattaacgcgaataccgttgacgccaaattcggcaggttttgaaatgccgccatttcttgatacttcagaaaagcttaaatttctcatgccgccttgacctgcttgggcagttctttgtgcatatatcgtaaatcctactgcattttcaggaacaactacataatcttcttttaattcccaagacccagcttgcccagtaaactcagcttgggtcgaggaaatatatccatttgatgcatcataaaaacgaatagatatatttgtagttccaagatcaagtaaatcagcatcagcatatagttgtgctttaagataaagaacatcaccaggaattaaattgtagtcagaaagtttacttatagcagctgaagttggcaatcgcgcaatttcattattagttcctccaaccgcagacataaattgctcaacgctttcgtatgttcttttaggaaatcctgtagctccgacgtcttctaaactatcaaatacaacatctaaaatagtttgataatcatctgtgctttttctattacttagtttaacatgctctaatgcaatagctcttttagaagaagtataaaaagcagcatatgatacgtcaaatcttgacaatactgaatctgatggaaaaactgaagttcctgctccccttaaccaagataccacttcaggaggaaaattaacctttccgctagttaatatagcagcaagtctattgtttgacaaagaattcatgaaactgacaaaagcagctgatgtagtattatttgaagcagaaaaagcatatgacttgctatcaactaatgctcccgtagaagggtcaaaaactcttaaatgaagacctgcactaaatgtttgatttccaacgggattatcctgaaatttaacatatggccccgcagtagaaagcgggcaagaacccgctatgcttattttatatcttactgaattgctttccgataaaaatggcgtttggacatatccttgtccaaactctgccataaatttttccataatacctcttattcaacccattcaaatttaacagttttattcactgggtcaggaataatgcgaacattaccaattcgtaagaaatcacgaatagtaagattacctattattccattatcagatgggatcgctcctatatctgaaggttgaggagggttacctccgtcaaatacctgaacaaaacttgaccaagagtttttggttttctgccatgtacgtgtccagcgagtggtacgtgcttctggggtcgttggataagtaatccaatcttggtaaagcgaatcaagtgtgttaccaaactgagtcaatgtaccaggagatttaacttcttcgccacgttctaagtatggaagcccagtcacttcattagttttttcaaccattttaaaataacccgggaactggttataagtggctgaatcattaatatcgattgaccagaatcctacagtatcagatgtcggcgcgcgggtatataaatcagaggttttagtaccctgagaacgaattctcgagttaacagtcaaaccacccgaacttatagtagcaccttttgcaatgattaagctttcaccaatcgttacttggccagatgcattattaatagctaaaggacgcaatccattaaatacgccagtttgatcacccgatgcagtaagcataaaattcgttactgatccatcattgcgaacaatgaaaccataatttccgttaatagcacggaaagcatttgcgcttcgagaaataatttcaccagttgcagtgactgaattaccaaatgttgctacaccatttgcattcaatgttcctgaagcattaacatttatcggtgttactgtaccgttgatattaaatgttatatttccagctttattacgctgagaataaaaatgactagacgtttcatcactaacttcaaatacggtagaacgtgttgtgtctgattccccactaaattgatttccccacactctgactgtcatcgtttgagccgggtttgttccagtttgaggtcctttctcaaaaatcagacgagttgccgttccagtattagaaatagttaatgtactatttgctgaaactgatccaccgaatgtagcagtactagatgatacaagaggggcactcagattcgtttgttgggttaaggttagtgaaccattaactgtttgtgcaatgtccctacgaatgaactggagcgaatctagaccatctaataaattactatctacggcttttgcttttaatggcaaataatttgctaatacgcgatttaattcatatggtgatactgcataaccatttttctcatatgattctaatggctgtgttgaaccagctgtatcattaccaacgaatgtaattgaaccagacgaagttttaacaaaacctcttatcgcagtagtcgctgcccaagtaggttcactctgcacaatccattttaaattttttggagatacagcagtatttgctgacgttccagctacagtttcagaccgagttgcaactttaataacgccttcctgtgcttcagtagatttagtacctaaaagctttttaggagttattaaaacattatctaatgttcctgcagcagcttcaacttgtgtagctacacgaagtgtaccacgctgtgtctcatttgcttcaagaatattaagggtataatggtcccagagagttcctgattcaactaatccagatagagcaacaacagaagtacgatcagtactattaaatctggttttaatttttaatggtgtagagatacgagtatcgtcgacgcctgcgtcgaattcaacctgtgtagcaatttcagctataccacttaaactttcagttgctctacggtcatttaaagttttaggagtgactgcacgagtataatcagttcctgtattaacttcactttgcgtagcaatttcaattaaaccaattcttccatcagttgatgtctttttatgtaacgtttctggtgttacaaccgcatttgcccatccttcttggctttgtccagcaattacttcactttcaactgctaaaattactgcgccttgttgcgttggagtagctttatactgatccaaagctttaggtgaaacaactaaattattagtgtttttattataaacattcgtaccatttaattcacgactagaagctggagtagctcctgcagtagatacaaaagttacaatacccgataatgtttcagaaccttgacgagcttgaagctttttaggagtgatgattgtagtatcatcgatacctgtattagtttcctgctgcgtagcaatttcagcaacacctctgcgagtttctgtagcagttctttcattcagctttttaggagtgatgataaggtcatctgcaaaagagaatgtagtgttctgatttacttgagcagtagttgctattcttgcaatacctctgcgagtttcagtagcagtacgattagctaacgtttctggagtaattgctaattctttttgtggagaattttctaaatcagcatttgcttgagcttgcgtagctaaagcaattacgcctaatcttgctctagtagaagcatttaaagagtctactctttctacagttggaacgttttgctgtacaacccagtattttccatcagaatcttctatataagcaagttgcaaaactggtacataattagtttcaccattaaaaactaattcttgaactgttacccattcagcttcaggcggatattctgaacgttttgggaattgcagcaattgaactgaagaagcaattttatcttcaccagcagctttgattttaactgtttgtccttttctcatgtaattcatggaaattttaacagtatcaccaacagaaatatcagtcggaagctgaagttcaattgtttgggttgttccattattcgcgccaaataccatgacttcttcatttggacgaatatttgaattagttgttataatgcgtaaacgtgctttactatccccgtcaaacaatctccacaatttctcattatcgtcaaacatcaagaaaccgtcaatcgatgtacggccttcaatggaatgagttccaacttcttgtactgaagtcgtttcatcgtatgtagtaacaattgtatgataaagtggattcagtttatctaaatcaacgaaattaataatatcgccatgattagcaaatctcggaagtttaacattaattggtgcagcagaagtaaatctacgtacgataaaatcattagattgtgcttgatacgcagtcgatggagtaacaatcgcagcttctctgctataatcagcaacatacatttgccacaaacgattattaaaaatgaatatcatctgtgactttggatgagtcattaaaactgaacgtacctgttcacctctaaaattgacaatactctgatttgaagaatttattttaacctgatttatgccaggttttccaccgatatcttgaattattacggtttctccatcaagcggagaaggtggtaaagtaaactcaatgtcattgccaactgatgtatctactgaaattgcttctccggattttaattgatatggtccagatgatacggttgtatatacggcatcagtacgtaatgctttccaacgaattctattaaaatttccagcaggttttggaatattatccgttgctgcccaaaaacgattattataaatgattacaaaatcttttaaatatccacgagttgggtcatattgctgaactgtgttttcttgaattaagtaatcaacgttaacaccgtcagttcctacggtacgatcagctaaagctacgttgattattttatcgccacctgcgtccagaccatcttctgctctgaactttcttttaatctcggccattctcccgggctcctattgtgttttcaataataagtatttatacctgtttactttaagatttagatagtatataatagaaatctcactaattgaacgaggttcatatggatttagaaatgatgctggatgaagattacaaagaaggaatttgctttattgactttagtcaaattgctctttcaactgctctggtaaacttcccagataaagaaaaaattaatttatcaatggttcgtcatttgatattgaactcaattaagtttaatgtcaaaaaagcaaaaacgcttggatacactaaaattgtactgtgtattgataacgcgaaatctggatactggcgtcgtgatttcgcttattattataagaaaaaccgtggaaaagcacgagaagaatctacttgggactgggaaggttattttgaatccagtcataaagttatagatgaattgaaagcttatatgccatacattgttatggatattgataagtatgaagcagatgaccacattgctgttcttgttaaaaagttctctttagaaggacataagattttaatcatttcatcggacggtgactttactcaacttcacaaatatccaaatgttaagcaatggtcaccgatgcacaagaaatgggttaaaattaaaagcggttctgctgaaattgattgtatgactaaaattcttaagggtgacaaaaaggataacgttgcttcagttaaagtacgatctgacttttggtttaccagagttgaaggtgaacgaactccttcaatgaaaacttcaatcgttgaagctattgctaatgaccgtgagcaagctaaggtgcttctcacagaatctgaatataatcgttataaagaaaatttagttctaattgattttgattatattcctgataatattgcttcaaacattgtgaattactataattcatataaattaccaccgcgtggcaaaatttattcatattttgtaaaagcgggtctttctaaattaactaatagcattaatgaattttgaggtgaataatggctaaaaaagaaatggttgaatttgatgaagctatccatggcgaagacttggctaaatttattaaagaagcatctgatcataaactgaaaatttccggttataatgaactgattaaagatattcgaattcgtgccaaagatgaacttggcgttgatggtaagatgtttaatcgtctattagctttgtatcataaagataaccgtgatgtgtttgaagctgaaactgaagaggtagttgaactttatgacacagttttctctaaatgatattcgtccggtcgatgagaccgggctttcagaaaaagaactttcaattaagaaagaaaaggatgaaattgcaaagcttcttgaccgccaagaaaatggatttattattgaaaaaatggtagaagagtttggaatgagttatcttgaagctacaacagcattcttagaagaaaattctattcctgaaactcaatttgctaaatttattccttcgggtataattgaaaaaattcagtcagaagccattgacgaaaatcttttacgtccttctgttgttcgttgtgaaaaaactaatacattagattttctactatgattaaactccgcatgcctgctggtggtgaaagatacattgatggtaaatcagtttataaattatacttaatgataaaacaacatatgaatggaaagtatgatgttattaagtataattggtgcatgcgggtgtctgatgccgcttatcaaaagcgaagggataagtattttttccagaagttatcagaaaaatataaattaaaggaacttgctttaatctttataagcaatcttgttgctaaccaggatgcttggattggcgacatctctgacgctgatgcacttgtgttttatcgtgaatatatcggacgcttaaagcaaattaaatttaagtttgaagaagatattcgcaacatttattattttagtaaaaaagttgaagtttctgcttttaaagaaatctttgagtataatccaaaagttcaatcaagttatatttttaaactacttcaatcgaatataatttcgtttgaaacgtttatcttgcttgattcgtttttaaatataattgataaacatgatgaacagactgataatttagtctggaataattattctataaagttaaaggcttatagaaaaattttaaatattgattcacagaaagctaaaagtgtttttattgaaactgtgaaatcttgcaagtattgatatgaatatagtatattggtttacatttgaagaccgtgtcaaaaataagactccaccgtactactatatcggtagtaaattaaattgctcatttgagaacggaataatatatgactcttccggaaaggaatactggagctcatgtaaacaaaaaagatttttgaatgcgctaatgcttcaaaaaccgagcgttaaaataattcaaattgatgatgacttggatgttattgaagcagaacgaaaataccaacttgaagtaaatgcaagagataatccagactattttaatctggtatatgctggtggtggatttggtgtgagtggtgaaactcatccagccaaagacccggaagttagagagcatatgagattggctaattatatgaaccgtgacgattttagaccttggaaaacatcacgagctaatatagagtcttggaaattatctcatattgcttacgagaattatgtgttattattatcctctaatctgtacggtaaaactcctggatggcgaagagttaaaggtaatataaatataactgatacaactgctaaatcgatggtaaagtatttcaacttaggttggatacctctcgaagacccagagtattgcgaattatgccagctatgaggtaaagtgtcatagcaccaactgttaattaaattaaattaaaaaggaaataaaatgtttaaacgtaaatctactgctgaacttgctgcacaaatggctaaactgaatggcaataaaggtttttcttctgaagataaaggcgagtggaaactgaaactcgataatgcgggtaacggtcaagcagtaattcgttttcttccgtctaaaaatgatgaacaagcaccattcgcaattcttgtaaatcacggtttcaagaaaaatggtaaatggtatattgaaacatgttcatctacccatggtgattacgattcttgcccagtatgtcaatacatcagtaaaaatgatctgtacaacactgacaataaagagtacagtcttgttaaacgtaaaacttcttactgggctaatattcttgttgtaaaagacccagctgctccagaaaatgaaggtaaagtatttaaatatcgtttcggtaagaaaatctgggataaaatcaatgcaatgattgcggttgatgttgaaatgggtgaaactccggttgatgtaacttgtccgtgggaaggtgctaactttgtactgaaagttaaacaagtttccggatttagtaactacgatgaatctaaattcctgaatcaatctgcgattccaaacattgatgatgaatctttccagaaagaactgttcgaacaaatggttgacctttctgaaatgacttctaaagataaattcaaatcgtttgaagaactgagcactaagttcagtcaagttatgggaactgctgctatgggtggtgccgctgcaactgctgctaagaaagctgataaagttgctgatgatttggatgcattcaatgttgatgacttcaatacaaaaactgaagatgattttatgagctcaagctctggcagttcatctagtgctgatgacacagacctggatgaccttttgaatgacctttaatagattatattactaattaattggggaccctagaggtccccttttttatttcaaaaatttttcataaaacggtttacatccttgtccttccatggtactatacaactatcggcaatactgctgataattaaagaggaaaataatatggctaaagttgatattgacatcgttgattttgaatatattgaagaaattattcgtaatcgttatcctgaacttagtatcacaagtgtacaagattctaagttttggagtattcaaatcgttattgaaggtcctttagaagttcttgagcggtttatggctaatgaatactgcgatggtatggatgctgaagacgtagaattttacatgggactgattgaacaataattatcaaggggctattaagcccctattaaaatgaggaaaatcaaaatggaaatcggcaaaaaatacgagttaaatccacatcgtattaaatctttcattgatattagttcatcaaatgctagtatggtcggcatcattcaagaaaatggcggttggtttgaagttaaatcaatatcaagtttagatggctttgattatgtaaccgaaatcatttgtgctaatggtgaaatctataatgatgatggtatgggtgatgattattttgaacttagtgaagaagagttttattgtttccgcgaatataaagaaccgacttctgaagaggatgaagtcaaagacaaggtttctggcgtaacaaaaattcactgcattgttgacgaaaacaatgcagatgaaatcattgaacttttgcgaaaaactttcaaaaagtagtttacatcagggtagtagtgtgatactattaccctatcaaaactaatggagaaaagaaaatgttcgcaccttatattatggcagcagttatgttggtctgtttatatcttttgattaaagcttgctaaggagaataaaatgagattacaacgtcagagtatcaaagattcagaagttagaggtaaatggtattttaatatcatcggtaaagattctgaacttgttgaaaaagctgaacatcttttacgtgatatgggatgggaagatgaatgcgatggatgtcctctttatgaagatggagaaagcgcgggattttggatttactattctgacgttgaacagtttaaagctgattggaaaattgtgaaaaagtctgtttaaggaaaataatatgatttttgtatttgaatttatgaatgatgaattcgattatgcaatttttaacgcattgcataatcctgatttaagtgaatttaatgaaatgttttctgatgctttgagtatgtcagaagaatactgtggagaatgtcaacgtgtttgtgtgacagtttttgaaaacaaagaaaagacgtatgaagaattattctttgatgctaataaagccactgaatggtttatcgaaagaggatttgcgtaatgattaaattggtattcgcttattctccaactaaaacagttgaaggctttgacgaattagcatttggtttaggtgatggtttaccatggggacgagttaaaaaggaccttcagaattttaaagctcgtactgaaggtacaattatgattatgggtgctaaaacgttccagtcattatctacattacttcccggtcgtagccatattgtggtgtgtgaccttgagcgtgattatcctgtaactaaagacggcgatttagcacatttctatattacttgggagcaatatataacttacatttctggcggcgaaattcaagtgtcaagccctaatgtaccattcgagactatgcttgatcagaattccaaagtaagtgtaattggcgggcctgctctgttatatgctgcgttaccttatgcggatgaagtagttgtttcccgcattgttaaaaggcatcgtgttaattcaacggttcaattagacgcaagttttcttgatgatataagcaagcgtgaaatggttgaaacgcattggtataaaatagatgaagtaacaacccttacggaatcagtatataaatgaaataacacgtggcggaaaatatgaattttaattattaccctattctattagaagaagacgcgaaacagccaaagtggcagggtcctcagtttattaaaggtgtctatcaattagtagttcctaaagacaagatttatagcagttgtttcactgaatccgcttgcagtattttcggtaatagttctccgtattggaattttgacataaagctggatagaaatatcgatatttggttgaaagctatggatattggtaatatcacgtttgatgagaataattatcatattattggtcgcttttccaaacgcggtaaagaattatatttcacgcctgaaattgagagaaaatttgatgctaaaccgtattgattatttagcttcataaaatgtattataatttatataaggtactaaatgaaacaataccaagatttaattaaagacatttttgaaaatggctatgaaactgatgaccgaacgggcacaggaacaattgctttgttcggtactaaattacgctgggatttaactaaaggttttcctgcagtaacaactaagaagctcgcctggaaagcttgcattgctgagctactttggtttttatcaggaagcacaaatgtcaatgatttacgattaattcagcatgattcgttaatccaaggcaaaacagtttgggatgaaaattacgaaaatcaggcaaaagatttaggataccatagtggtgaacttggcccaatttatggaaaacagtggcgcgattttggcggtgtagaccaaattatagaagttattgatcgtattaaaaaactaccaagtgataggcgtcaaattgtttctgcgtggaatccagctgaacttaaatatatggcattaccaccttgtcatatgttctatcagtttaatgtgcgtaatggttatcttgatttacaatggtatcaacgcagtgtagatgttttcttgggttaattgaggcctaggtataaggtgacttatacttgtaatctatctaaacgggggacctctctagtagacaatcccgtgctaaattgtaggactaccctttaataatttcatcaggattagttacttaccgtgtaaaatctgataaatggaattggttctacataaatgcctaacgactatccctttggggagtagggtcaagtgactcgaaacgatagacaacttgctttaacaagttgaagatatagtctgatctgcatggtgacatgcagctggatataattccggggtaagattaacgaccttatctgaacataatgcttccatttaatattgcatcatatgctacgttagttcatattgtagctaagatgtgtaatcttattccgggagatttgatattttccggtggtaatactcatatctatatgaatcacgtagaacaatgtaaagaaattttgcgtcgtgaacctaaagagctttgtgaactggtaataggcggattgccttataaattccgctatctttctactaaagaacaattggaatacattcttaaactcaggcctaaagatttcgttctcaaagattatcagtcccacggcgtcttgaaaggaaaaatggcggtgtaatttcaatttaattgcgaggatatatgattttacgatttaaagatacttctggtgcagttctttttacacttcctaatccaagtgagctagaagttccaggaccaaatcagcctattatcatttatggcaaaaaatattatactcataaaatgactcgtgagtattttgataataaaatttctacagttaaaacttcttctgattgttactatgatattactgttttaacggaaaaacaatatgacgaattatcaccgcgcgggccgtctatgtcgggtagtgaataaatataaatccgactttgatgtcaatattcaccgcggtacattttggggaaattacgtcggtaaagatgctggcagccgggaggctgccattgaattattcaaaaaagattttatacgtcgaattaaatccggagaaataactaaagcacatttagagcctttacgtggaatgaggctaggatgcacatgtaaaccaaagccgtgtcatggtgatataatagctcatatagttaaccgattgtttaaagacgattttcaagttgaggacttatgcaattaattaatgttatcaaaagtagtggtgtttctcagagctttgacccgcaaaaaattattaaagttttatcttgggcagctgagggaacatcagtagatccttatgaattatatgaaaatattaaatcatatctccgtgatggaatgacaactgatgacattcagactattgtcattaaggctgctgcgaattctatttcggttgaagaacctgattatcaatatgtagctgcacgttgtttaatgtttgctcttcgtaagcatgtttatgggcagtatgaaccacgttcatttattgaccatatttcttactgtgtaaatgaaggtaaatatgaccccgaattattgtcaaaatattcagcagaagaaattacatttttagaatcaaaaattaagcacgaacgggatatggaatttacttattccggggcgatgcaattaaaagaaaaatatctagttaaagataaaaccactggtcaaatttatgaaactccacagtttgcatttatgactattggaatggcattgcatcaagatgaacctgttgatagattaaaacatgttattcgtttttatgaagcagtatctactcgacagatttcattaccaactcctattatggctggttgccgtactccgactcgacagttcagttcatgcgttgttattgaggcaggagattcattgaagtctatcaataaggcttccgcttcgattgttgaatatatctctaaacgcgctggaattggtattaacgttggtatgattcgtgctgaaggttctaagattggcatgggtgaagtacgccatactggtgttattcctttttggaaacattttcagactgctgttaaatcatgttcacagggtggaattcgtggcggcgctgctactgcttattatcctatttggcatttggaagttgaaaatcttctcgttttgaaaaataacaaaggcgtagaagaaaaccgcattcgtcatatggattatggtgttcaactgaatgatttgatgatggaacgattcggaaagaacgattacattactttgttcagtccgcatgaaatgggtggagagctttattattcttattttaaagacaaagaccgtttccgtgaattatacgaagcagcagaaaaagaccctaatattcgtaaaaagcgtattaaagcccgtgaactatttgaattgctcatgactgaacgttcaggaacagcaaggatttatgtacagttcattgataatacgaataactatactccgtttattcgtgaaaaggcacctattcgtcagagtaacttgtgctgtgaaattgctattccaacaaatgatgtgaatagtcctgatgctgaaattggattgtgtactctctctgcattcgtactagataattttgactggcaagaccaagataaaattaatgaattggcagaagttcaagttcgtgctcttgataatctgttggattaccaaggatatccagttcctgaagcagaaaaagctaaaaagcgtcgaaatcttggcgtaggtgttaccaactatgcagcttggctggcaagtaactttgcttcttatgaagatgctaacgatttaacgcatgaactatttgagagattacagtatggactcattaaagcatccattaagctcgccaaagaaaaaggaccttgcgaatattattcagacactcgttggtctcgaggcgaattacctatcgactggtacaataaaaagattgaccaaatcgcagctccaaaatacgtttgtgactggtcgtcgctgcgggaagaccttaagctctttggcatccgtaatagcacattatcagcacttatgccatgtgagtcatcttcccaagtttctaacagtacaaacggtatcgagcctccacgtggaccagtctctgttaaagaatcaaaagagggctcctttaatcaagtcgtgcccaatattgagcataacatagacctttacgactatacatggaaattagctaagaaaggtaataaaccttatcttacgcaggtagctattatgctgaaatgggtatgtcaatcagcttcagcgaatacatattatgacccgcagatttttccaaaaggaaaggttccaatgtcaataatgattgatgacatgctatacgggtggtattatggcattaaaaatttctattatcataatacccgtgatggttctggtactgatgattatgaaatagaaactccaaaagctgaagattgttcatcctgtaaattatgatataatttgactcacggacgagtcaccaactattaactaagtggaaaatttatgagcacagtttttaatacaaacccagttgatgttttaaaagaacctatgttttttggttcaggtcttggtattgcgcgttatgatattcaacggcatcgagtatttgaagaacttacagagaagtccttatcatttttctggcgcccggaagaagtaaacttaatgatggatgctgcacagtttaataagcttcctcagtatcagcaaaatatttttactaacaacttgaagtatcaatcacttttggatagcattcagggtcgtgcgccgtctgctgtacttatgtcattaatttcagacccaagccttgatacgtggattgctacatggacttttagtgaaactattcacagtcgttcatatacacatatcatgcgaaatctttatactgatccatcgaaggtatttgatgagattgtattagatgaagctattatgaaacgtgctgaatccattggacgttattatgatgatgttctgattaaaactcgtgaatgggaaaatgctaaagaatttgtagaactatctaaagaatctcctgatgccgactttcgtttaaaccgagctattaaacaagaagccgaagctaaacgtgctttaatgaaatctctttacctctgtttgcacgttattaatgcattagaagctattcgtttttatgtatcctttgcgtgtacctttaacttccataagaacatggaaatcatggaaggtaatgccaagattatgaagttcattgcgcgtgatgagcagcttcatcttaaaggcacccaatatattattcgtcaacttcaacttggcactgatggcgatgaatgggttaaaattgctcaagagtgtgaacaagaagcagttgatattttcatggaagttaaccgccaagaaaaagattgggcagttcatttatttaaagatggagatgttcctggattaaatacaaatagcatgtggagctttattgattacttaactgtatctcgtatgaagcagtgtggtcttccatgcccaattaccgatgctccggttaaacatccatatccttggattcgtgaatatcttaattctgataatgttcaatctgcaccacaagaagtagaattgtcatcttaccttgttgcacagattgataatgatgttgatgataaagttatgatgagttttaaaaaatacttttaaggagtgggccgcaaggcccattttattatgaaagaaattgcaacagaatattcatttattaaatatactgagctagaattagacgacaacggaagtataaaacaattatctattccaaacaagtataacgtaatttatgctattgctataaatgatgagcttgtttatattggaaaaactaaaaatttacgtaaaagaataaattattatagaactgctattaaccgtaaagacaaaacgtctgattctactaaatctgcattaattcattctgcgctaaaggaaggaagcaaagttgaattttacgcccgccaatgttttaatctttctatgacaaatgagttaggtacaatgacaatcgcaacgattgacctagaggagccgctattcattaaactgtttaacccgccttggaatattcaacacaagaaaaaatgatgcttccacatggagtgtggtactatattcaaaacacaaaagaggatacacaatgcaagaactttttaacaatttaatggaactatgtaaggattcacagcgtaagtttttttactcggatgatgtaagtgcatctggaagaacttatagaattttctcatataattatgcatcttattctgattggttacttccagatgcactggaatgtcgtggaattatgtttgaaatggatggagaaaaaccggtaagaattgcctctcgtcccatggaaaagttttttaacttgaatgaaaatccattcacgatgaatatcgatttaaatgatgttgattacattctaacaaaagaagacgggtctttggtatcaacttatttagatggtgatgaaattctgttcaaatcaaagggttcaatcaaatctgagcaggctttaatggctaatgggattttgatgaatattaatcatcatcggttgcgcgatagacttaaagaattagctgaagatggatttactgctaacttcgaattcgttgctccgacgaatagaatcgttcttgcttaccaagaaatgaaaattattttactgaatgttcgtgaaaacgaaacgggtgaatacatttcatacgatgatatttataaagatgctgctcttcgtccatatctagttgaacgattcgaaatcgatagccctaaatgggtagaagaagctaaaaatgcagaaaacatcgaaggctatgttgctgtgatgaaagatggttctcattttaaaattaagtctgactggtacgtgtctcttcatagtacaaaaagttcattagataatccagaaaaattgtttaagactattattgacggtgcatcagatgatcttaaagcaatgtacgctgacgatgaatattcatacagaaaaattgaggcgtttgaaacgacttatctgaagtacttagaccgagctctgtttttagttcttgactgtcacaataagcattgtggtaaagatagaaagacttatgcaatggaagcgcaaggtgttgctaaaggtgctggaatggatcacttgttcggtatcattatgagtctataccaggggtatgatagtcaagagaaggttatgtgcgaaatcgaacagaattttttgaaaaattataaaaaatttatcccagaaggatactaagctgtttacaagtccctcgtgttgtgttatagtagtcttactgacataacatgaggactttatgatggatttgcagcttattactactgaaatggtcgttaaagcatacggtgatactacagatgggatttctgtatttaaaggaaatcgtcgagttggatatatcaccgatcttaagaaagatttagctaagcaagtcaagcggaaaacgaccattaaagaatatcgaaatcgtcgtcttgagcaagcccgtgatatgcttcctgatgcggttgaggagatgaaagtctttttagaaaatcagcttgcgaaatatgattgcgatgtgttcattaatcagactcaacctaatgttcatattaacaactgtaaatgctatatcatcgttaatcctttaacgggaaaacatcgtcttggaattagtaatccaaatcgtagcgcatcggatatggcagaagatgttgaggcatgctttaaaatttctaaatctccggctgaacatcatattttaattaacggtctttctcaagacgatattatagaggttattaaaactttatgcaattaagtaatacgacagcaggtttgctattaattgtaattgcattaggcggaacttctttaattttaaaaaataaaattgaaagattagaaacgtctgttgtagaaattacaaaaacggccaatgaaaacgccttagcattaaataatttgcgaattcagtataattatattgatgcgatgaataataaaaatcgtgaggcgattgctgctattgagcgtgaaaatgaaaaactgcgcaaagatgcaaagaaggcggatgtggtggctcgtaagccaggattggttgaaaaacaaatcaacaactccttcaacaagttcgcagaagacatccaggacctttctaaatgattagactatcagcagtaatattatctatcggtcttctagctggttgttcgacaaagcctctagaagtaaagaaagaaacagttcatcctaattggcctgtacaaataaagtcatatgacgaagctaaattatcttggcaagttaaagttattgatggcaaagcttgggtcggtatgccatttgaagattctcaggaatttcgtatttggcttaatgatgtaaaacgatatgtacatgaccagaaaactatgatatgttattatcgtcaagagttaaaagaggataaatgtaaatgatttcatggcatcaatttgaacatctcaaaggattgatttatgaatccgagatggctgcaatgatttatggacgccagattcagcgattagaatctttacctccaactaatgatgttttattagctcaatcacgtgctaatcttaaaaatgaataccaaaataagtggggcaaagcatctaaagacctgcatgattatattcaatcattagttgagaaaaataaatgaaaactctgctagaacgttatattgaatgctcagaccgttacattgatgcatgtcatggtgcagtatacatggatttggatcgtggaatagtattaaatgatgaagaccctgctaaagctttagatgatgctggtaaagccctgcgaaaagaagcgaaagctcgtgggcttgatatgtatcagcttaaaaatcacatgataaaatttatttcatccaatgttcagagtaaatcagcgaatcaatcaacagctgaattgtacaaaggacggtgtgagcacaatattcgtattcttgaagttttcttaggaattaaatgatgaaaaagattattttgactattggctgtcctggttctggtaagagtacttgggctcgcgaatttattgctaaaaatccagggttttataatattaatcgtgatgattatcgtcaatccatcatgggtcatgaagaacgcgacgagtataagtataccaaaaagaaagaaggtatcgtaacttacatgcagcatgatgttgctaacatgattctctgccaagacgcaacgaagggtgtaattgtttcagatactaatctgaatcctgaacgacgtaaggtctgggaagagtttgccaaagagcttgggcatcaaattgaatataaagtgtttgatgttccttggactgaattggttaaacgcaactcaaaacgcggaactaaagcagtaccaattgatgttttacgttcaatgtataaaagcatgcgagagtatctcggtcttccggtatataaagggactcctggtaaaccaaaagcagttatttttgatgttgatggcgcgttagcaaaaatgaatggtcgtggtccttatgaccttgaaaaatgcgataccgatattattaatccaatggtcgttgaactatccaagatgtatgctcttatgggttatcaaatcgtagtcgtttcaggccgtgaaagtggaaccgaagaagatccaacgaaatattatcgtatgacccgtaaatgggttgaggacattgctggtgttccattagtcatgcagtgtcaacgcgaacaaggcgatacccgtaaagatgatgtagttaaagaagaaattttctggaaacacatcgcaccacattttgatgtgaaattagctattgatgaccgaactcaagtagttgaaatgtggcgccgcatcggtgttgaatgctggcaagtcgcttcgggagatttttaatggcttggcaccatgaaacttgggctattgttattgtaaatagcggtttagttggtactagtaatgggcaattttgtgtatttactagtgaaaatagagcatgggaggaatgccttaaattaagagaaaagaatcctgatgttgaactagtagtaaagaaaactaaactgcctttaccatggaaaacgtatgaataacctagaaaagatttatcgtctttgtgataaaattgaaaaagaaaagaaatatctattttgtctatggcctattgttgacggaagagtaggcctagatgttcttgattatgaaacagaagacaaagtagatggcgcaacttttgataacgctttggatgttattgattggctcgaagaaaattatgtgaggtaaatatgtttccgacttactctaaaatcgtagaagtagtgtttagccaaattatcgctaataatatgtttgaaaaacttgataacgcagctgagcttcgaatccacgctcaagtgactcatgtattgaacactttgcttccagaccaggtggattctattgccattacgttgtatccaggttccgcgcatatcattgttgtattcggtcttgatgctgagctagttatcaaaggcgacattcgctttgaatctcaaactgcggaattcaaagcgatttaatggtttactttacggtagagttgtgatattatagctctaccaaaacaaatgaggaaattgaaatgagcgaatggtttgaagaagataaggtttatcgctttaaaactgggtataaagatatttttaatgaaacttgcggggctaataaacgaatcgcccagtttattggggaaaattcatttaaagtaaaaattgaccctgcaaagaatgttattagcattaaacgcgaaattgatgattgttggtataaagctgttgatgtaatgggtgaatcctataaagttagcccgttattttcaattgcttatatgttagaatattcttttttcgaagaagttcaaaaagatgattctgtcagtaaatttgaaattaaaactgataaagaaattaagtggaaagtagtaggtattactggttgcatgttttatatctatgctcaaactgatacaaaggaagaagctaaaaagaaagctctagaatatcttgaagagtatgaagaaggcccggtaatgattacccaagatgctgaattagtttctgtcaaattagttaaaaacgttgaaagtaaggagctgggatcaacatgctaagcgaaaaaccaattactgttaaagaattccaagaaaaagttaaactatttgctcaagaattggtaaataaggtttctgaacgatttcctgaaacgtcggttcgtgttattaccgaaactcctcgttcggtattagtaattgtgaatccaggtgatggtgaccaaataacacatctcaaattggattttgatggattagttgaagcacaaagggtgtatggcgtactatgatgaatttaactgatataattgataattgtcttgaaaatgatactggcgatcatagagcgcttgactctgaaacagcaaagttcattagaataactttaatgaatgatactctggtgaatagtattcatccttctgtgtatgatgctattattgtgacgaagtatccagttgagcttcacaaaaagatggttggcgcaatttttattgataagaaaaaccgctttaaagatgggcagaatataattagttctgttattaaaagtataactaaacttcgtcacgaaatttatcgtgttgaaactgctaaatctgcttatctggtgattatgaaatgaaagcgagtacagtacttcaaattgcatatttagtatcacaagaatcaaaatgttgctcctggaaagtaggagcagtaattgaaaagaatggacgtattatttctactggatataatggttcacctgcaggtggtgtgaactgctgtgattatgctgctgagcaaggttggttgctgaataagcctaaacatactatcattcaaggtcataagcctgaatgtgtatcgtttggttcaactgatcgttttgtattggcgaaagaacatcgtagcgcgcactctgaatggtcgtctaaaaatgaaattcatgctgaactaaatgcgattttgtttgctgcacgaaacggttcttcaattgaaggtgctactatgtatgtaacactttctccttgcccagattgtgcaaaagcaatagctcaatctggaattaaaaagctggtttattgtgaaacatacgataaaaataaacctggctgggatgatattctgcgaaatgcaggtattgaagtgtttaatgttcctaagaaaaacttaaataagttaaactgggaaaatatcaacgaattctgtggtgaataatgaaatttcgtttggtacagctcacagcaattagttcttattccaacgagaacatttcatttgctgtagagtataagaagtattttttctctaaatggaagcagtattataagtcaaactgggtttgtattgatagaccacatagttggaaatctgatttagaaaaatgccaaaaattactttccactcttaaagaacgtggaacaactcatattaaaactgtaataggtaaataaatgaaactgacgactgaacaaaaagtagcaattcgtgaaattttgaaaactaaattgtccatgggtgtttcaaacgtagtttttgaaaagtctgatggtactattcgtgttatgaaaggtactcgcgatgctgactttatgccaaccatgcaaactggtaaattgactgaatctacccggaaagaatctactgatatgattccagtatttgatgttgaacttggtgcatggcgaggtttttctattgacaaattgatttccgttaatggtatgaaagttgagcatttgctccaatttattggtaaataaatgctttaagaattatttgttattattaattcatctgttaacaaaaaggaaaaacgatgtctgaagtacaacagctaccaattcgtgctgtcggtgaatatgttattttagtttctgaacctgcacaagccggtgatgaagaagttacagaatcaggacttattatcggtaaacgtgttcaaggtgaagttcctgaactgtgtgtagttcactctgtcggtcctggtgttcctgaaggtttctgtgaagttggtgatttgacttctcttccagttggtcaaattcgaaacgttccacacccttttgtagctctgggtcttaagcagccaaaagaaattaaacaaaaattcgttacctgtcactataaagctattccgtgtctttataagtgatataaataataatatgaattgggtgtcggaataataagttaaccgaacaattctatgtggtagtctacaactgagagatctgtcgaaagaagatgaaattcagaagaacgtgactaccgagttttaatctctaacgagaatttttaaatgattaaacaattacaacacgctcttgaactgcaacgaaacgcatggaataatggtcacgaaaactatggcgcatctattgatgttgaagccgaagctcttgaaatcctgcgttatttcaaacatctgaatcctgctcaaactgcattagctgctgagcttcaggaaaaagatgaacttaaatatgctaagcctctggcttctgctgcacgaaaagcagttcgtcactttgtggtaacattgaagtaatttattggagattcactgccttagtgtgagctaaatcgaggagccgtcgaactgtctgattaatgatttgcgaatcattatagttttaagaccccggcagttttacggtgtacctcttgaatgtgaatgatgacgggtttatggttatcctggtcgttaaatatccaaaaacctatgttccccttgagggcttgcgcaggcaatgccaataagtcctgcattttcatttaaaagagaatttataatggcaaaacaagctaaagcaaagaaagcagttgaaaagaaagttggtgattctaaacgcgctggctacaagcgtgggtcgaactctcgtatcaatcaaactgttgagaagatcatgcgccgagcacgtgcggttcttcgagatgatgcttctcgttttggtaagcagaaagcataagttgaggactccttcgggagtccttttttattttccaaagattgcataaagttgtttacagtatggttcctttgtgatagtattatcttacacaaacaaaggagaataaaatgaaaacgattaatctgaacgctgcagttaaaactaaatgcttcaatggtaaatatgatgaaactatgtggttcttaatggcagttgaaggtgatattattgaagtagaaacaacagaaggtatgggaacagatttcacctttacaattcaagttcataatttctttactggttggatttatgaattgaatacagtaatcgttggaaaaattgaacaaaatgaattaggtgaatggtattatgttacagctcgccaacgtgccgaacgcttaattgagaagatgaaaaaagttggtaaacttgatatgcagcattggaaagtagtaaaataattgtttactttggtacaggatatgatattatatacctgtaccgcaattaaacatcttggagaataaaatgaactacatcaactttgaacgtaaatatgtttctaatggtattacaggttctattgataccatctgcctttggaaacatcaaaatggatcagtatgcgaaattgaacagtacatgactcctaattacgtttatatgcgatttgaaaacggtatcacggtttcaatcacgatggaaggttccaactttaaaatcgctctggatgatgatttccgtgaacgcgatttagggactcatccttgctggaatggcgttaatcgcaagcttttggttaaaacttggattcgtcatattctgagtaacagagctaaacctgagcatcttgaagcaatctttgatgtagttcttaacgaatttgatatttaaaataaatgaggggctttggccccttactgaggaaaatgttatgtttatgaccacttattttgatactcgtaaaaacttctgcgaagtagttttctcaaaggcgcctaaagaccttcctgcacatttgcagcctactagcgaatcgattaaaaactacgttgatgtggtttgtcctttagagtttcgtactgtaaatgggcgcgatactttagctatcactaaactcaatcgtgaaattgacattgacccctcaattgcacgtgaaattaatagttctgatattaatggcggtaatgttaaatcgcacggttttcagatgaggttttaatgaaattctttttaggtcaaactgttgaattaaagggagttggtatacctggattaatttctaaggttctacctccgtttaaatggagtggtattcaaataaaagaggcttatattgttttctgggtagatggaaatgaagaccttcgtatgggtgatgaattatctcctatctacggattaaaggaaatagtatgaatataattaataagatttttggaattcagtacattaaggtcacatataaagtaacagataaaaatccgtatactgatgaacatgaagaaccgcaagttgagtctattatattagaaaaggaccctaactggccagttgaatttcgtcttccttgctatggtcattgggctgatgttgaaattataagcattgaaaatgtctgagttagagattagaagcaattttaggtggccatcatgtgcattaagtaatttcgcccattggcctttcgttatggatggcattcaatttggaggtcttgaaggattcctccaaggatgcaaggtgaaaaacgttgaacaacaacgtcgtatatttgggttatccgggcttgccgctcaacaagctggaaggtcttatgcaagagctcaggaccgtgggaccctcttctggcttggagttccattttcaagatactccccggcgtggaaagaattatacacaaatgcatattttgaagcagcgatccaaaacaagggcttccgtgatgcattacaagcctcgaaaggaaaagttttgaagcacagcatggctagtggtctaacaaaagatgatacaatactaaccgaagctgaatttattgatgtgttaaacctattaagagactctctatgaagcctactattttaactgatattgatggagtatgtttaagctggcaatcaggccttccttattttgctcagaaatataatcttccgttagaacatattttaaaaatgatccaggatgagaaatttatttctcctggtaaactctttaattgtgacgaagaacttggcgttaagctaattgaaaaatacaatcgttcagattttattcgttacttgtctccatataaagatgctctgtgtgtaattaacaaattaaaagaagattataattttgtagctgttacagcattgggtgattctattgacgctctgctgaatcgtcaatttaatttgaacgctctttttcctggtgccttctcagaagtactgatgtgtggtcatgattcttcaaaagaagagttgttcaaaaaggcaaaagagaaatataacgtaatttgttatattgacgatctcgctcaccattgcgatcatgcgagtgaaatattaaatgttcctgtttattggatggctcgaggggagcgtgacaatattccaaaaactgctcagcgagtttatacatggaatgatgtagagaataagattttttcgccgaaggaaaataaagaaagttttgatcgtgaaaaagctataaaagatgcaatcgagaagatgattaaaaacgattcttttccttggaacactacctggagaacgcctggatttaatccttataatcatctatatcatccatatcagacacatccgtttcagacatggaactatattaaacctggtggcatagagtatttgtataatagacctactagtggtgataatattttccaaggagcattctaatgtttgttgttcacactatttatgaaaatgaaggtaatactacacgtgattacggtcacgtaaatcaattttttagatgcaatccagaattccgagctcaaaaagacgaacgaatttttaaaaaatgtgtagagcaaggtttcatttacgtcaagcactggatgcaaggaaataaagttagaaccacatatcataagtctttgactgagcttaatgatgaattgatttataatagagctgtaaaccaaactctgaaggatgaataatgattcttaaaattctgaacgaaatagcatctattggttcaactaagcagaagcaagcaattcttgaaaagaataaagataatgaattgcttaaacgagtatatcgtctgacttattctcgtgggttacagtattatatcaagaaatggcctaaaccgggtattgctacccagagttttggaatgttgactcttaccgatatgcttgacttcattgaattcacgttagctactcggaaattgactggaaatgctgcaattgaggaattaactggatatattactgacggtaaaaaagatgatgttgaagttttgcgtcgggtgatgatgcgagaccttgaatgcggtgcttcagtatctattgcaaacaaagtttggccaggtttaattcctgaacaacctcaaatgcttgcaagttcttatgatgaaaaaggcattaataagaatatcaaatttccagcctttgcccagttaaaagctgatggagctcggtgttttgctgaagttagaggtgatgaattagatgatgttcgtcttttatcacgagctggtaatgaatatctaggattagatcttcttaaggaagagttaatcaaaatgactgcagaagctcgccagattcatccagaaggtgtgttaattgatggcgaattggtataccatgagcaagttgaaaaggagccagaaggcctagattttctttttgatgcttatcctgaaattagtaaagctaaagaattcgccgaagtagctgaatcacgtactgcatctaatggcatcgccaataaatctttaaagggaaccatttctgaaaaagaagcacaatgcatgaagtttcaggtctgggattatgtcccgttggtagaaatatacggtcttcctgcatttcgtttgaaatatgatgtacgtttttctaaactagaacaaatgacatcaggctatgataaagtaattttaattgaaaaccaggtagtaaataacctagatgaagctaaggtaatttataaaaagtatattgaccaaggtcttgaaggtattattctcaaaaatatcgatggattatgggaaaatgctcgttcaaaaaatctttataaatttaaagaagtaattgatgttgatttaaaaattgtaggaatttatcctcaccgtaaagaccctactaaagcgggtggatttattcttgaatcagagtgtggaaaaattaaggtaaatgctggttcaggcttaaaagacaaagccggcgtaaaatcgcatgaacttgaccgtactcgcattatggaaaaccaaaattattatattggaaaaattctagagtgcgaatgcaacggttggttaaaatctgatggccgcactgattacgttaaattatttcttccgattgcgattcgtttacgtgaagataaaactaaagctaatacattcgaggatgtatttggtgattttcatgaggtaactggtttatgaaagcttacttagaaacaattgtcattgctcaaaaagaaggtggagatgtttctacttctgtatcacaagtcattctcgaatttgtagatgcatacgcttataataaatttacagaaacatttgatgcctatgaaaaaggaccaaagtttgaaatatatcgtactctcttaccactagattactaaaggccttcgggcctttaattttataaatagaataaacactagagaggctatgatggaacttattacagaattatttgacgaagatactactcttccgattacaaacttaaatccaaagaagaaaataccgcaaattttttcagttcatgttgatgatgcaattgaacaaccaggctttcgtttatgtacctatacatctggaggtgatactaatcgcgatttaaaaatgggcgataaaatgatgcatattgttccttttacattaactgctaaaggttcaattgctaaattaaaaggtcttggtccaagcccaattaattatatcaattcagtttttactgttgcaatgcaaacaatgcgtcagtataaaattgatgcttgtatgcttcgtattcttaagtctaaaaccgctggtcaagctcgacaaattcaagttattgctgatagacttatccgtagtcgttcaggtggcagatacgtccttcttaaggaactctgggattatgataaaaagtatgcatatattcttatacatcgcaaaaatgtatcactagaagacattccaggagttccggaaattagtaccgagctctttactaaagttgaatcgaaggtcggtgatgtttatatcaataaagataccggagctcaagtaaccaaaaatgaggcaattgcagcatctattgcacaagaaaatgataaacgttctgaccaagctgtaatcgttaaagttaaaatttcccgtagagcaattgcacaaagtcagtcattggaatcttctagatttgaaacaccgatgtttcaaaaatttgaggcttcagcggcagaattaaataaaccagcggacgcgcctttaatttctgattctaatgaattaacggtaatttctacttcaggatttgcactagagaatgctcttagcagtgttacagctgggatggcattcagagaagcttctataattcctgaagataaagaatccattattaatgcagaaataaaaaataaagctttagaaaaattacgaaaagaatctattacttcaataaaaactttagaaactattgcttctatcgtcgatgatactttagaaaaatataaaggtgcttggtttgaaagaaatattaacaaacattcgcatttaaatcaagatgctgcgaatgagttagtacaaaattcttggaatgcaataaaaacaaagattattcgaagagaattgcgtggatatgctcttaccgctggatggtcactacatcctatagtcgaaaataaagattcatctaaatacacaccagcacaaaaacgcggaattcgtgaatacgtaggttcaggatatgtagacataaataatgctcttttgggattatataatccagatgagcgtacaagtattttgacagcatctgacatagaaaaagctattgataatttagattcagcctttaaaaatggtgatcgattgccaaaaggtattactttatatcgttcacagcgaatgttaccttcaatatatgaagcattggtaaaaaatcgagttttttattttagaaattttgtatcaacatcattatatccaaacatttttggtacttggatgactgattcagctgttggtgttttaccagatgaaaagcgtctaaacatttctatcgataaaaatgatgaagggcttgttaattctagcgataatttagtcggaattggatgggttattactggggctgataaagtcaatgttgttttacccggtggaagtttagcgccttcaaatgaaatggaagttattttgccacgtggattaatggtcaaagttaataaaataactgatgcatcttacaatgatggaacagttaaaactaacaacaagcttattcaagctgaagttatgaccacggaagagctcaccgaatcggtaatctatgacggagaccatttaatggaaactggtgaattggttgcaatgacaggtgatattgaagtagaagacagagttgactttgcatcatttgtttcatcaaatgttaaacagaaagtagaatcatctcttggaattattgcgtcttgtatagatattgcaaacatgccttacaagttcgttcaaggataaatcatggaacttattacagaattatttgacggcgcttcggcgccggttgttaacttaaatcctaagcataaaataccacaaatttttgctattcaagccggcgaagaaagcgtgcttcctggatttagattttgtacatacacctctggtggtgatacgaataaaaacgttaagccaggcgataaaatgatgcatatcgtaatgataggtgttaatgagaaactatcattagttaagcttaaaaacttgggtggaaatccaattggtgtcattaatgccgtttttgatactgctcttcaaacaatgaaacagtataaaatcgacgcatgcctattccgcgtactaaaaagtaaaacaaatggcgcagctcgtcaaatgcaagttattgctgaccgtttagtacgtactaaaggagcaggtcgatatgttcttttaaaggaaatctgggactatgataagaaatatgcatatattatggtttaccgtaaaaatgccaatttagaagacattccaggtgtacctcctatttcaactgagttattcacaaaagttgaatcaaaggtcggtgatgtttatgtagacgttaaaacaggaaatgctgttcctaaagctgttgctgttgctgcttctattgctttagaaaatgataagcgcacggaccaagctgttattcagaaaactaaaattagtcgtcgattagcagcacaagctcaatattctactgttgatgcttcacttcagggtgatagcttcgctgctaagaaatatcaagagtttgaatctaaagttccggtatataaagcagaaggaccaatgaactctggcgttattcagattggttcaaacttcagcaaaggagctatcggtggtatgagaagtgcttctcgttttaaatctaacgattatgaactagaaagcttccgaaatcatattgcattagcccatgcacgtttacgtgatccatctatcaagttgcagagcgatataacatatcaaggttctcaagaatatttaaagaataaagaattctttgattataaaactgataaaattttaagcgatcttgctgatattaatatttctaatagctttgatgttattaagaaaattattaatgatttagttaaaggttctaaaaccacaccagatgaaaagacagctattattcaatttgtaatgaatggcatttataaattgattaatgaatctgctgcccaggcatatgaatacgcaagcaccgaagtagctccaaaaggactgactcaggctgaatctgatgtaattgaagattattgtgcagattcatatgttgaaatgaactcgttccttttgggtaaaccagattctacccgtgaagaatacatggaacgagctattaagcacatcgagacgttagattctgcctttgccaaaggatcagttcttcctccaggaactacactttaccgtgggcaagaagttacctttaaaactttgcgtcataacattgaaaataaaatgttctatttcaagaacttcgtatccacatcgcttaaaccaaatatcttcggtgagcatggtaaaaactatatggctctagatgattccggcgcagtattttctggtgaaggagaaggttccgttgatgcagaagatttgatgcatatgggtagtcattctacatatgctaatgaagatgcagaaactagcgtgggtatggtaattaaaggagctgagcgaatcaaagttatcgttccaggtcatttatcaggatttccatcagaagctgaagttattctaccacgtggaattttactgaagattaataaagtaagtacgtactttatgaaagaaactgcttataacaagtatctaatcgaaggtacaatcgttcctccttctgaacaattagaagaatcagtatatgatggagaccatctaatggaaactggtgaagttcgtccaatggctggatttaatcaattccttgtagaagaatcaaaagaagaggaaaatgaagtttctcaaatcttgacttctttggttaacatcaacggaatgtctaaaaagttcaaaatgtagtttacaagttccttatgttgtgttatagtagtcttactgacataacatgaggaacacaaaatgaaatcttctttgcgctttttaggtcaagaacttgtagttgaaggcgttattcctgctgataatgcttttaatgaagcagtttacgatgaatttattaaaatttttggaacagataaaaagttcggaatttttccttctgaaaatttttcaaagccagaacagactgaaagcattttccaaggtgtagtaacaggtaaatttgagtcagaagctccggtaaaaattgaagtttatattgaagacagtttagttgcttcagttgctgcttttatttcattccgtaaataaaaatatggggaccgaaaggtccccattgttatattgctcctaatattttactttgcgaattgacaattcctgtcatagtattaatgtttgaaatgcttcctgcagttccacctaatctactgagtcgtgaaagcgaattagatagtccagtaacacctccactatttccgagaacgctttgaataccatttatagcagcagattcaagccattcaagcgcagcttgcctatcaactgctccagcctgcatgactctatatgcaaaagtaacatcaaatgtagttatttggttatctccatcatatgataactcaggagcgctcactgacactggaatgcatccggtgaacattaccgcagtatgaggtaatccattgcgagaatgaagattaacctgaatatctgcctcgacatcttgtggcaaagcacgcagtccagttactgggtcttgaacagcgttaacccagtcttgcattgcacgatagttacaagcttctgaatccattctaaatgaaataaccaaagggtctaattctctcccagttatacgaatattaggagagttgtagttccagtcagtttcataggataatctattctctggcatttttacagagtatatcatcaatccagatgagttatatgccatgttaaagaagtcaattaaatatgtaccaactgtaaatgagcctaataaactttgaactgtacgttgactcatggcaccaataagatatttactaacccctgattttcttatcagtttttgtgtgccagcagtaattagcgtggtaattccctgattaatatcgccttgagacaatcctaaccagtctgaatttagacccaagttattataagaaaagttgctaattgaacttatcaacgaagagcttttagttgatggagttgttgcaaaaacgcagctaaacatattattacgttggaaatctgcgtttattgcttgattattaaattcctctaaagaatacattaaaaagtccccgcatataaagaagcacgatttaacgtgataatttctctcatagtaatctcaagagtaaatgtactagggaggtttggagcaatagctaatccgttaaaattaccattcggagttttatcaaatctaatactttgaatttgacacggtccaaacacttctgtttttccgtcaaatttagaagttgcgccaaagtttttaaccatccaaattgtcgggtttgaaactacaagaacgttagttaaactcgatgtcattttctcaaataacgtcttatttttaactgcatcttctggagttaatggctcaataaaagtagaacggtaccactcatctaaatatccttttatttcagcagcatattgagatttaccagtttcaccgtaagaaaaatagttaaaatactgatagatattaataatagccattaaatcttctgttgagcgcggagtcaaatcccaagtgaacactttagttctattttcagcaccgccgtacatgcttctggctgtcgtataaatctgttcattattatcagccattataccttgtgttatactttccagcgctccaaatactgcggttgaagccatattgcttagcacaccagtagcagtacctccaccttttgtaataagactatcttgaacatcattaaatctatgtgatgacgtatcgacgtcagatttagatctaggtaaaagaatatttgcaacaggaactttacttattgttcttgaattattatctgatattagtccatttgatagttttgatactgtattactgatagtgtttctggctgtacgtaaaatactcgaagatgaagaagagtagttagatctcatcgttctaagacttccagaatccctagatgacatattgtatgcagtaaataataatccattcttatatagatctgttacctggaagtcccctgtagtgtcattaccactagcacgcccagttggaaactgggctgtgtatgttttagttcctacttctgatttagtactctgtccggctgaaattgtttcaccggactttttaattaaatcagcagttatttctttaacaattgccatattattccttaattaactcccgtcgcaccaaatacaccaggagcagttgtgcttgtgacaggtgtcatattatgaacgacagtatttttcttaataacattattagtattattgattgaaggagatgcttgttgaacaggagcttgttgtgctttgttcttttcaatcacctggacctgttttgcttctggtgatttagcagaagtttcaggttttgcttcaggttgatttttcttgagctcttgataagtggcatcaattttagcaaatctagaagcaagttcttttttaactgctggtgaattatttaaatccggatcattcattcgttttttaaggtcttcatgagcagcttcaattgatttaactgtcgagtctttgctcatatcagctgaatcagcatatttttcaaaacgaatcatcgcagcacgagcttcattagctttcattaaagcattttttctttcttccggtgaaagttgttttaatttttcttcttctgctgcacgttcttcgtcagtagtcaatgcttctttattatctacaccacgaatccagttagatgcacgagttttccagttcgcaattttgtctaatccttctgctattgggccaagatcatcattcattcgtttatcttgataatttgctactttttcttggtcttctttattaagagatgctccagtagaattttggaaattttctaatgctcttccttctacttcatcagcagtatccttcatgccaggaatgactcgaagaattgctgcagataatttagccatacctaattgaataagctctcctaaattataaagaacacttccaagcccttcaacaatagctactgttaatccgccccaatctccagcttcccagaactttttaatttcatcaatagattcaaagatgctttgtaataaagggccccaagttcctgtttcgcttgagaaagttttaaaatcagtgctaaataaatcccaggcttttgaaaatttatctgaccagtatttaaaatgaaccatcagcaggtctattccaataacaacagccattatcaatgcaaccattttagcagcttcaatagcagcactgacggtatacttaaatagcatgctagatattttatcagtaattgaaatagatttcttaaatccgaaatcaactgtctttgttaatttatctaaagcttgagataattttaagttaaatgcgtctcttttttgcttctcttctggagactcttgttttggttcaattggctgaggagtagggaaaaaatcagcatcaggatcattattaactgcttcaggagccggtaataaaggacccacagattcagctgtatcatcctcgacgactttaacaggaatagcattttctactactgctaaactcgttccagtctgttgaattccagctgtttgaattttttgttctaataaactcgttaatttatctaatttgcttccgagtgattcgcctatttctttattgatattattgccaatttcaacagtctcggcaattaactcagaaccagcagtagtatcactcactgcgctttctacattgtcaattgctccaattatttcattcgatttttcttcgacagtttgagcaattaattcagaagcagcttgagcatcatccaatttcgtagatatatcgttaagcccagataaagtgttggaagcggatttagccgcttcctgtgttggtttattatctgaaataacttttctacgcatcgtttgcatttcttgtggctttttcattcaaataatccaataatattaccaattccagttattggaccattagggccaggaattgctaaagttgtaaaaatatcatttgcccattttaaaacgaatgctggcatctcaagaaaattaatttctttaacttcatcattgaccttaagcaagcatttggataacatatcgctcacagttaaaaattgttcaaattttccaggcggtctaaaataaaatgtatttccttggtattgaaattctaatctttggcatacataaacatcattaatgtcataagtatagccatctatttctttacgagatttaatctttccattaaattccaataaatgaatagaaacgaaatcaacttctgccggtgacaaattcggacaaatagaatcaataagaagttttaaattttcatcagggcctttaacatcttttaaaatgttataatgtttaagacccattttaggaatagaaacttctttattgcttattggaagaactactttcttcagtggtagtatcagatttaaattcatttttaaccttaactgggtctattgtttccagtttcgttgcattagtgaacatatatagatgagttactgaattattatttgataattcatggataacttcatcaacgtaaaattctgttttaaattggtttttactatcattaaaaataattttaacaccaggagtcaagttaaaattaccgacagtagaacatttagcatagccatcatattgcgccatagtttgaagacgaatagcttcttcatagccattcctataagtcatttcagaataagcacctgaccttgacactacaatagagttttcaccctttcctgtagtaatcattggtagtgaagaatctaaaaacgaatgagcatagatagtagcatttttcattggatcacgtttatgcgggtttgatttagtcaaccaaacaaaatcatatgccaatggatattttaattcttggatgaattgacctattaaagatggctcacctacaatcattggatatggttcttgatttatcatcatatcatagtccatcatgttaactcccatgatgtcttgccacacaaatacaaatttgtcacttcctacagctagagcaacttctcttacataggacaaataattttcaaatgtactagtccatggaatatcaggaacataagcatttatagcatttattgctggagttaataatgtgcggtcttgataaatgacaccaagcatttcttttatagattcacctgcatcagggaaaaatggtctaccaaatttaagattttctatagaatgaatagttcccaattcaatagcaatgatgttatcgccttttgaatctactgacacggaaaaatgcttgcatccataaattcgtgttttaacattattaatatcgtttgcattagctacagaaatttgaattatttcatttccatccatttttgtgtggatatttttagaatcataaaactgcagcattccttcatttcgaccataaagagagtcacgcatagttaatgtggtaatagtagcagctaattcaacaaatctattattactccaagcgtcataactctcaaataatttaacgctgagatttggatatccaggacgttgtaacatactcattgatgtttatccttctcaatcagttttaatacgaatccgcgctcggcaggaatcattttcattattgaatttaagctataattactttttacaagcgtgtgattaatttgataaaaagtaaatatctcatctggattaactaatagcttaaacacatctactatatcagtgtattttttaatgtacttatcacaacacgacatgtgcaatgttaaattaataggattcattgcatcgagaattttttctaatgtttctatctcgatggcgtcaacaagttctatttgactcgattcactaatttccttccaatcataccacatttcatctacttgaacagaatgaatattttcagtaatcatctttgctttattttcataaaactcagaaggaaaatttaatttaattttaacattagctacatcaaaaataggttcctttaattctttttgatatatttcaaatggaactgtcttttcttttttacattttggacatacaaatgtgactggtactttagttttacctattgaacctacaaatacctgcaaaaatataaatggttgccaagtcttcggatagtctccaaaataatcatcaattaaatcagtaattatttctttttgttcttgtggtgaccgatgttctatatcgtttcgaactaacaaaaaatctcgataatcttctaccgtaaatggtttaaaacgatgaacaccatctggtaatttacaacgaataatgtttgccatagatgctccttttattctatttataaatatgataaataaaggagctaaatatgtatgaatacaaatttgatgtgagagttggttctaaaataatcaactgtcgcgcatttactcttaaagaatatctagaacttattactgccaaaaataatggttctgtagaagtaattgttaaaaagctaatcaaagactgcacaaatgcaaaagatttaaatcgccaagaatcagaactattgttgattcatttatgggcgcattctcttggagaagttaatcacgaaaactcctggaagtgcacctgcggaactgaaataccaacccatataaatctattacatacacaaatagatgcaccagaagacctttggtatacacttggtgacattaaaattaaattccattaccctaaaatttttgatgataaaaatatagcccacatgatagtatcatgtatagaaacgattcatgctaacggtgaaagcattccagttgaagacttaaatgaaaaagaactggaagatttatattctatcatcacagagtcagatattgtagctataaaagatatgcttttaaagcctactgtttatttggctgttccaattaaatgtccagagtgtggaaaaactcacgctcatgtaataagaggactcaaagagttctttgagttactataatggcaaatattaataagctttattctgacattgacccagaaatgaaaatggattggaacaaagatgtttccagatcgcttggattaaggtcaattaaaaacagtcttttgggaattattacaacaagaaaaggttcaagaccgtttgaccctgaatttggatgtgatttatcagaccagctttttgaaaatatgactcctcttactgctgacacagttgagcgcaatatcgaaagcgcagtaagaaactatgagccacgtattgataaattagcagttaatgtaataccggtttatgatgattatactttgatagtagaaatacgcttttcagtcatcgataaccctgatgatattgagcagataaaactacaactggcttccagtaatagagtataatgcttcacgtataaacgtggtataatgaatctaagtccatccaataacaattgaatagagaacaatatgagattagaagatcttcaagaagaattgaagaaagatgtatttatagattcgactaaattacagtatgaagcagctaataatgtgatgttatatagtaaatggcttaataagcattcaagtattaaaaaggaaatgcttagaattgatgcacagaaaaaagttgctcttaaagctaaattagactactactcgggacgaggagatggtgatgaatttagtatggatcgttacgagaaatcagaaatgaagacagttctatcagctgataaggatgttttaaaggttgatacctcgttacagtattgggggattttattagatttctgtagcggagctcttgatgctattaaatcacgtggatttgctattaagcatattcaagacatgcgagcatttgaggctggaaaataatgagatatagcattgatgatgcttttaattatgaagaagaatttgaaacggaaattcaattcttaatgaaaaagcataatcttaagcgtcaggatattcgtatcttggccgaccacccgtgcggtgaagatgttctttatattaaaggaaaatttgccggatatcttgatgaatatttttattctaaagatatgggcattgatatgcatatgagagttgtataaatagatatataattcagaggagacaatcatgtcagataagatttgtgttgtctgtaaaactccaatcgattctgcattggttgttgaaacagacaaaggtcctgtacatcctgggccttgctataattacattaaagaactaccagtttcagaaagttcggaagaacaattaaatgaaacgcaacttttgctatagtgtgacctttagtctatagttttggcccttcctttttggttgggccttttttaatttaaaagctttcttctacttcatcgtctgaatcttctaattcagctctttttcctgccaaagcatctctgactgagatgtcatcagtatcttttaattcagtttctttaactcttttcttataataagcttcaagttcttctaaaccttctaatgtttgacaagaggcaattttacccataaattcatcaatagaagcttcataaagaaattgtttaaattctagtaacatctttttctccaaagggccgaagcccttataaattaactgttttcattacgtaattaaatttttcatctgcgtagcgctgaatacgatcaatgccgtgttttaaaagatagttcaagtgaacatatttctttttagtattagcagattttggcttgacaccacagtcatctatgaggtcccagactgttgcgattgttttagaaccatgtttacgtaatacgcgacctattgtttgcaatacaataattttagatttaacaccgtgtgctaaaacaacgtgatgcagatttttaactgaaataccagtagaaaatacaccataactagctactataattattcctttaccgttttcagctaaggttttcattatattgcgggtttcggtatcaacttcccctgatacgtaataaactttatcgtattcatttttaattaaatcgaaaatagctttaccgtgcgatacgtgtttaaacatgacaaaagcgttttcatctttttgtgcaagcttaatagctaatttagcgatccatttatttcttttactaagcccagtaataatttttatttcttcttggtaagtttttccctttaatttagtagtgaactcatcgggatagcgaagaaaaatactattaatttttaactcagttacttgtccatcttccattaatttagaggtcgttactggcttaaatatttcaccgaacattccaacatactgcatgatattggctttgccatcacgtaatgaaccagacaaaccgaatttgaacatgcagttatttaaacctgatatgatagatgaaatactttttcctgtagcaagatgacattcatcattcatcatcattccaaactgtgagaaccattctttcggttgttttactacagtttgccatgtaccaacaacgaccggtgcatcatttttatatttatcatcttttgatgctccaccaccgattttctttatcattgcatgactgaataaacgatagtcaacaaagtcatcagccatctgagttgtcagagcagttgttggaacaataataagaattttgccttcataattttccaaataataccgagcaagcaaagcttgaattaaagatttacctgcggatgttggaagattaagaattctacgacgattaactaatccttcgaacactgcatctttttgataccaatgcggttcaattcttttatttcctgaatagatttctaatttagaaagccattcatcaaaatcttttcttgataattcttctttttcgttaatctgtgggtcaatccaggctttatagccaaagttatcgcagaactttttaatttgcccgactaaaccgaatggaagaaggcgattataatctaaaagacgaattcgtccatcccagtggccatatttgtacttcggattaaaacgatacccatcagcttcaaagctaaagaaatcacggagttcatgaaatgtactttcttcgcaatcaattctcacgtgactaaaatcataaaaatgtactttaatgtcagtcatgtctaaataccatgtaataaatatatctatatttatactgaggaaatattatgatagataaagattatattgcagagctgaaggctcttgatgataataaagaagctaaagctaaattagctgaatatgctgaacagtttggtataaaggtcaaaaagaataaatcttttgataatatcgttaatgatattgaagaagctctccagaagctcgctagtgaacctatgccagagactgatgggttatctattaaagacttaattgatgctgctgatgccgcagacggattaaaatatgacgatgaagaagtcaatccagaggcagcacttctgattgattctccggttaaatctgacattaaaattgaagtagtagaaacggataaaattcctgaaaataccactgttttaattgaagataatccttttgttgaagaaaaattcgaacaggctgtagctgagattattgaatctgaaaagccgtctgtatttactcttccggaaaactttagtccgaatcttcagctgattggaaaaaatccaggattctgcactgttccttggtggatttatcaatggattgctgaaaccccagattggaaatctcacccaactagttttgaacatgcgtcggcacaccaaactttatttagcttaatttactacattaatcgtgacggatcagttctaattcgtgaaacacgtaattcttctttcgtaacattaaaataaggataacttatggcttttacagttgatataactcctaaaacacctactggagttatagatcagactcagcagtttactgctacacccagtggtcaaactggagatggacctattacatatgcttggactgtagacgacgctccacaggaagaaacgtcagcaacttttagttatgtactaaaaggacctgccggtcaaaagactattaaagtagttgcaaccaatcaagttgcagaatctgaacctgaaacagcagaaattagtacaactatcacagttcaaaataagacacaaacaactactttagctgtaactcctggtagccctgatgctggagtgattggaactccaattgaatttaccgctgccttagcttcacagccatcaggtgcaaacgctacgtatcaatggcacgttgacggttctcctgtagacgaagcaactgacgctacattcaattacactcctgacacaagcggagttaaaaaaatcaagtgtgtagctcaagtaactgcggcagattatgacgcaaaaacagttacttctaatgaagtatcattgactgttaataagaagacacagacaactacgttagccgtaactcctgctaatcctgctgccggagtaattggaacagccgttgaatttactgctgccttagcttctcaacctgatggggcatctgctacgtatcagtggtatgttgacggttctctggtcgatggagaaactactactacatttaactatactcctaccacagttggagctaaaacagttaagtgtgtagcgcaagtaactgcagaaaattacaatgaaaaggaagttacttctaatgaagtatcattaacagttaataagaaaacaatgaatccacaggttacattgactcctccttctattaacgttcagcaagatgcttcggctacatttacggctaatgttacgggtgctccagaagaagcacaaattacttactcatggaagaaagattcttctcctgtagaagggtcaactaacgtatatactgtcgatacctcatctgttggaagtcaaactattgaagttactgctgtcgttactgcaactgattacgatagcaaaactattacagcagaaggtcaagttcaggtaactgataaagttgctccagaaccagaaggtgaattgccttatgttcatcctcttccacatcgtacttcagcttatatctggtgcggttggtgggttatggatgaaatccaaaaaatgaccgaagaaggtaaagattggaaaactgaagatccagacagtaaatactacctgcatcgttacactcttcagaagatgatgaaagactatccagaagttgatgttcaagaatcacgcaatggatacatcattcataaaactgctttagaaactggtatcatctatacctatccataatcataatcataaggggcttcggcccctttcttcattttgaaagcacacaaaacatactcagaaaatgatgtatataatggcatcaactcgataacatgagattgattatgagaactgaggttgtggtgtttactcttcatgagtctggaaagtcattcattgaaattgctcgtgaattaaacttacaggcgaaagaagtggctgtattatgggctcgagctatgactgctaagaataaatttgaaactcgagaaaaagttgtctatagaaaaagacatattaataaaaggtgaaaaatggaacagtatgatctttatgaaaatgaatcttttgctaatcgattacgcgaaaaagcacttaaaagtaaacagtttaagctagagtgttttattaaagatttttcggaacttgctaataaagcagctgaacaaggtaaaacatattttagttattattgtactgctcgcgataaattgattactgaagaaattggtgattggctgagaaaagaaggatttagctttaaagtcaatagtgatcagcgtgatggtgattggttagaaattacattttgaggattaattatgtttaaaaagtatagcagtcttgaaaatcattacaactctaaatttattgaaaaactttatagcttgggattgactggtggggagtgggtagctcgtgaaaagattcacggcacaaatttctcattgattattgagcgtgataaagtaacttgcgctaaacgcactggtcctattcttcctgctgaagatttctttgggtatgaaattattttgaagaattactctgattccattaaagcagtacaagatattatggaaacttcagcggttgtatcttatcaagtttttggcgaattcgctggacctggcattcagaagaatgtcgattatggcgataaagatttttatgtatttgacattattgttactacagaaagtggtgatgtgacttatgtcgatgattatatgatggaatcattctgcaatacatttaaatttaaaatggctccacttttaggtcgcggtaaatttgaagaacttattaaattgccaaatgatttagattctgtcgtccaggattataattttacggtagaccatgctggattagttgatgcaaataaatgcgtttggaatgctgaagtaaaaggcgaagtatttaccgctgaaggatatgtattgaaaccttgttatccttcttggatgcctaatggcaatcgcgtagctatcaaatgcaagaactctaaatttagtgaaaagaaaaagtctgataagcctattaaagctaaagttgaactgtcagaagctgataacaaattggttggaattttagcttgttacgttacactgaaccgagtaaataacgttatttctaaaattggtgaaattggtccaaaagattttggaaaggtgatggggctaactgttcaagatattttggaagaaacttctcgtgaaggtattactctaactcaagcggataatccttctttgattaagaaggaattagttaaaatggtacaagatgtacttcgtccggcttggattgaattggtaagttaaataaaaagggacctttcggtccctttgttttattcatcaatgataatttttggtagcttaacacctaataaaacagacaaatctgaacgacccgccattttatccatatctccaccatcaattactcttgcttctttttcatcttttgctacagtgtaaggatttgcagataaagcatatctaactaataaaccgatagatggctgcaaactttctggatcaactacaactttaaatgcacctacatgttcagggtcatctaagtcaagaccttctgtatacggagcatagaaaattgatccaacaatttctttttcaccaatattttctactacgccaacgattacataatctaatggactgttggtatcgcaataaagcggtaaaccattagctaagaacccgtaggcattttgtgaaagatatttgtcatcttctggtttatgttttaaccaacctgatgcagcaagaatcgcagcggcacgagctgaagcaacacagaacgttgctgtataagttgattctttctggatatgtgaaaccatttcacacaccattcggtataatgaacgaccagcttcaggtgcagatgcataactcaaatcaatgaatccagtatcagtaattcctgtaactttatagcgttttgatactgtaatcaaagactgcagaatatctttattgatttcatccgccatttcagttgcaagcaaatcttccaagaaattaggagcatcgaatccgtttgcttctaaatcttgtgctaattcaactgtgatgccagttttaagtttacgagatttaactgcggtttgccatttattaatctggaatctagcatccgcaatttcgctatcagagttttcaaatttgcttgttactgcagcatcagaaaatagacgaacctttaaaagaacgattgcaatctgaagagctaattctaaatcgctttcttcaatatcagcaaatggtgtatcttctaatactttataaacgatattattatatttgaataaatcgcctttattgagagttaatttagactcttctgttaattctgtgatttgttctcggtctacatacccagcttcgccagcgtaagtagcaccagttttaaatgtaaattcgttatccgggttaaggtatttgataccataaaaagcagcaacaggttgattagttctttgcgttgctacaatgtcagaatatattaatttagtggtagcgcgagtcaaagcaacgagatttgggcgaccgattgagttgctattcgttgtggttgattcgcgcagaagttcgttgattttagccattgcgctttcctttcagtttatatgatttatttataccataaaaacaactaaagggacccgaaggtcccttaaatcgtcaaagattagatacctttaacatatacacggcggaagtaagcgtttttaccaaggctattcagaatagaaggcataccgctctggatgcgagaagccggagcctgagcagcggattctgcaaatgggttgataccgataccgtaacgagttttgaatcccattaccggttggaagttcttcggatcagaaccacgcagcggagtcagagctacatatggagcatagtaaataccagcatccatttcgttcggacctttataacctacggtgaaataatcctgtttagcatactggtcgatatatacacggtatttaccacccagaacaccagcaaatactgacttggtagtatcagtgttaaagccagtagccagaccttgtgcagcataagaaatgccggtatcaactgaagccagaacgttaactacgttacgggaagcgataatgaagttaccttcgccgcgaccagtctgacgagcaatttcaactgcttctttgtcaatctggaacaacagagctttaaaggattcacctgcccagcgagcaccacgaatatcgattgggtcctggaagtcaaatacaccagctttagaacccggagtcagggtcataccagatttaccaacctgagcggagtagttaatccaatcaacaacttcgcggttgatttccagcataatttcggtagccagaataccagacagttcagcatcagcatccataccgtgaacagcgcgaaggtcttgtgctaattcaatagagtaagcagctttcagctgacgagatttagcttcgataacttgcttatcgatacggaagcccatttcattccatgggttatcggtagaaccgttaaaaccttcctgaagttcagcgatagaagtagccataccttcagcgatttctaccagtacaccagcttccatttgtttcttaatttcagcatctaatttgtctgcgtcagatgcgcctgaatcaatttgtttaacttctgtagcttgcagatatactgtaccagtttcctggaagaagtgagtgtaaatagttccgacttcaagagtatcacttgctttcaaagcagcgaatttcttagcagcaccctgaccagagaacattgcatctggaccatacattgggtggaatgcttctttagcaccggaagcgattgggtctttaccatatactgcgcgcagtgcgaatacctggccagtcgggctgttcattggctgaacaccacaaatatcgaaagcaatcaggttaggaatagcacgacgtaccatacccataacagctgggccaatctgagttactgctccagaagtctgacctgcagcgatgttggtagcattgtaaccgtggtcaccaccgatttcagcttctgttaagaaagaaccgaatgcctgagcaattttttcgtctttatattccggagctgtctggaaatctttttcctggttttcaaagattttagcgataatcgcttgtttgctattagcaatttccggtaaaccttcaccttccagtaatggcttccatttgttcaaaagttcagctttagttttgatagtcatttgtgttaacctttaaaattagaaacgagatgcgactttcgcatatacacttacaatatcttctgcaccttgtgcagatttatcttctacagcttcagtgacgaaattcagtccggctgcttcagtatcaggagtatttatactctcagtaatagtgctttcatctttattagatttcttcaccatttctacgattgcactcaatttacttgagaatgcatctgaataatccataccttcgaccagagcagagactttttctttttgagactcagtcagatctttagtactttcgctcaatgccacttcacgctgcacataattgatatatgcgtcacgcttattgagttcttcgaacagacgagctgattcttctttatgttcttgcagttcttcttccatttcagctacaacatcaactgattcttctggaacaacaacgttgtgttcaacgaagagctctttcaatccaccaagcatggattcaaacagttcggctttgatacctttatctactgctaatttattttcagtgagccattcttttgcaagatggtcaaggaatttagaagcttgctcagcgattttcttctcagctttttcttctgcttcttctttatttttttctacttcttcttctgctttttcagcaattttagcgatatgagattcagctaatttaacggcgtgctgcttgacggtagcttcgaatacagtgccgaaagtttcttttgcttccggagaaatattaactgattcgaaaatactatcaagagcaacggaagcatcaattttttgcgcttcagcaatcagttgttctttaagcattttgtagtcctgttgtttagataataatatttataacgcttttttcatggcctctgcgagagccatataggcgtcatcggcacttgtatcggcttccgccgtctgtgattcggtaatttccttaggagttacccatgcatctggagcacttggaccccatactgcatcaacacctacagttaatttgaatccttcgtttacgatacgataacctttatttgtgtcagtcaatgaacctaatccacgagaagaaactcctggaatccatccggcacgaatattagctgctaatttatctccaggaccgtggtcaccttcaataacacgagctcgtccgtatacgtcatttcctttccaccacatatcttctataatgatagcggcttgcatcgggtcaacattagcgcgtggaggatgatttaattctccgagagcttgtttagttaaaacttgctcattaatatagtcttttaccgctttttctaatatacgttttggataaagacgtttatttctattgacgacttccgcttgcatgaatattccttcgatgtataaacccggttttaaacctaagtcttttccatcatgagattcaagcattggtacgccatcaataatttcgccaggttgaccccaagtttcaattagtaattggggttcattcattagcttaatcctaatgctttacggcgtttaagagcttttttacgcttacgctgagcacgagattgacctgctggattggcaatcttcgttttggtagctttacgagcaatttgtctacgttttgctttagacaacccggtagtttgaaatgcattacgttcgcgggttttgcgatctttagtgcgagtaatttcaccacgggcagaaacatgtttaacgataaattcatttaacggcatattttcattaatagaagctaatgcaaccgctaaatcagtttcatcatcaagcatattctcgacaattgtatttatatcgtctttatttaaagcagaagacaattcgtcaaagcgaccctgtgcttcaggaataagtgcttcgacattctcgagaactaattcatgagtttcagggatcagaagcattattcatcatcctcgtcttcgtcagagtctttgtcttttttgtcgtctttatcatcactatcttcgtcttcgtcatcatcctcgtcatcaggttcttcaccttcgattaagaaattacgagcgatagcgattttttcttctttaattaaatcagtcgttcttgcagccatggcttcagcaaataatttacgagcggctacgaggtcgtttgatttaatagcttcaattaaaccttccattaaaaatcctcttgttcttggtcggggtcttggaaacgagcctctttagactcttcttcaatttgcttggcttcttgttctatttcttcatcagtcatctgcaaaatatctttcatagcagttctgtgagaaatatatttaccaataaatggttctgccatggttagcatattaattcttcgttccaaaatttctgcttctttgagctcagcaaagtagctatcccgatgaaattctatcttaatattatttatttcatcattccactcatcttctgtgattatacctttaagcaaaagatttgttttaagtggatctaggaaaacttcttcaaacttgtgctgtaactcacgaataaatttagcaaacgttaattcatcacgtgtaatgctagttccagaatcaaacatcacaccgccttgttggtcttgtggaatgcgtgaaagaggaacacgtaatgccatgtaaagagcttgtctaaaccaacgaatatcttccatattgccagtattatcagcaccaggaagagtatcaacttctgtcacagctttaccatcacggcgctgcaaccaatagtcttcggtcatagacatattatgttgttgattttttattttacctgttgatgcatcatatactacacggtttttcatcgtgttcataacatgttgcatgtgctcagcagctttacgagcaggcatattacctgtgtctacataccaaacacgacggtcaggagcacgagtaatgcgataaatgactacagcatcttctaataattttaattggttagcaggtttaacagcacgatgtaaatacccgatgatatttttgccacagcaatcgactaatccagaatgggcataaacaacagcagcttttggaatttttatttttgtgccagcttcatacattctaccatcacatgcatatgactcatgggcagtatcatatataaaatattctttgtaacctttaactatttttgtgccagcttcagtttctgttataatttcgcgaacatactgaacttggcgagggtctaatctacgtaattcttttatgccttcttttggacgttttggatcaatgattttatgaaagaaaattcttgaatcaacataccaacgtctaaaatgatcagaaccttttcgttgaaacgatagatgatttaatacatcactaaattcatctaacatcatatttttaatttttggactaaatttagatttatccaaatttaacgctacgacttcagtatcatcttcgtagacgatagcatctgaaacgatttctgaaactgcattatctacttcatagttattcatgagattacgatatgtatcaataagctcacgagtagttttcattcctggttcatatgaaccaaaaattgtttggaatgcagcattataaggagaagcagcttcattcgagcttacttcaaattctcttgctccatcatcaagctttggggctgtaatggaaacaagatcttctttttcttggtctttaaaatttcgttcgtccattttagcccatggagcaaacaaacttaatacattaaatttcattgtattctccaaatgggaattatagttatatttataatggacttctctgctttaagcaggatggggatttctccccattcattttattcccaataatcgagagcaagagttacttcaaaggtttggatttcattgtttgaatcccaatctaattgaagttcacccacgttagtaggccacagacctttaatttcaatttcttttgttactgttttagcatcacgagcatattgacgaacaatagcgctctttttatactctgcaggttttccaccagtaatttcgtttccttgaccagcagcaatgctttgccaatcaacaaacttctggcgagcatcatgagcttcatcgttcattactgtaacagtccagtcatcgaatgtacgatcgcctgctacgttaattttacggttcataaatccgactggaattttttctacaataccagctggtaaagcagtggctttacattggaatgtaaaattttgtccaagataagaaatttctacttggaataagttaggtcgagcaaaatcaccagattcaaacgctcgtgttacatcatctacaaacatattagcctctgtagtatttatatccctatgtttaacctagggcatatagaattaaagaattaaggatatagtgtatttatatggcctgccgaaacaggcctttagaatcattctagtaaatcccaaagatctacactatttctttttgatttttctcggttagattcccaagtgattatttctaaattattaataccgccaattattttagcaggaattaaattatcaaaaccgtatttgatagataccttatgatcaagttggtaagcgccttttgtaccacacactcctattttatcagcatttggccattttgaccaaattttcttatgcttacgagtttctttatataccgatgaaatatattcacgcatttcagatttatttgggttccatcttggatgatttacgccatgcatacattctactgtttttcctttattcgcggaaccatatgaattattgcgcattttatctttatgacggcaatcacgacaaatatcagtgtttcttccaatgcgttggttatattcaattccacatttatcgcaacggcattttacatacgcggtactacctttaatgtcttcaactttaacatcaatttcataatacctaaatccatgtttaaccgctccaagaggtgttaatttataaccctttgattgataatgtttaaaatttgatggtacaattttcactttaataaatttagaaataatcacttgattcctcgagaataggggccgaagccccatatcaattaacctgcaagaccagttaactcatcgaaatctgcaccagtagcagttgcgacgaaattcaaagtaatataatttatactgcgcgccggttgaatgtagaatgttgcaacaaactcatttctatcaattactgacggagtgttatttgttgtatcgcaaactacacgatattcataaattccaccgagagctttaattccctgtaagtactgggcagtttctgtgcggaatgatgaacgagtaaacgcgttgtttaattcgaacaaacgatattttgaactacgtccgatattcgttttcaacatattaaacagacgacgaacgttaatacgatcaaatggagaaggaacagaagtagctgttttatcaccatacaatacgtaaccatcaccacctgtaccagttactgggttgatagcttcttgatataaacggtcgcgctgagcttggcgagtttcaatagcaagtttaataacgttaagaatctgaccacgattataaccagctggagacatccaagtctgagaaacgttatcagttctcgcgcataaaccagcaatgtcagctgctaatggaacccaacgatttacatcattatatttgtcatactgatatttgtagttaccatcaattgctgcgtaggttgaactaatattaaagttattatcagtatatgaacctgccgcagttctccagttaactaaattatctactgcacgagttacaggaattccaacaacagtttcacgcggtggtgagcacaatactaagcaatcttggcgagcatctccaattgaaacgacgtgtttttggacagtagatgctgtttctaaagattcaccggcacaagaacccgcaataaacagttgaacgtcaacagattcacggtcagcaaagaagtcccaagcttccatcaaatctcctgctgtaacttcagcatttgatgataatccaccagaaagagttaaaattccagagaatccttctggccagttttgtgcagttgcaaaaatatattctgaaccaccttttgcgaaaaagtcatcgatatagatgttactatcgtaaatatctttttcaccacgcttagttgaaagaacaacgctttgaacaatagcatcatttcgacgaactataatagcgtactgtgagtcagtctgcggcccatatccaaatactgccttggcagtagatgcacgagtaccaccacctggataaattggcagtaatgcagaagcgcctttcgcatagtcagctttagatacgatttcaatttcaattttatcgcctaattcgcctggatagagagctactactcctggaattccatatttttcaagatttgcctgaaaatcaactgctgtcatagcagtttcagcgctctcgatttcagctaataaaataccggaatcagtaataatttttccaagagttattactgcagctaaaccggaagaagatgaagaaatttctgcagtccagttagaacctaatgttgggtattcgccaacttctttagctttagcaataatttttgcagtaggaatattaattttcttaatttttccatcagcatctacttcggtaattttaccttctgtttcaacatcttctgaaacatatttgaccgtgattttatctccaaccgcgtagttactacctggggtagaaattgtgtattcaatattaccagcaatcggagatgagtttttagcggtatctctatcgacagcgcgcacaactcgcaaatcatttccatattgtaagaaattcattgcagacataaaatagtcagcagtttcagctgtaggttgaccaaaagtattaactaaatctacttcgtttgtaacctgtttaatctgaaaagcaggaccccactggaatttaccggccaaagctgctgtaccagtagagttattaaccacggtgctttgaaccgtagtttctttgagctcaatgcccggagataataaagtcatttttaatcctctttaatatgctttaatatatttataccattgacataccatgagatactggaacatactcagcagaatgaaccgaatcaacaaatataactggagcgtattcatcccccatatcttgaagctcttttgaaaacacttcagatgctaatcgcatgtcatctttgtcggcataatcaataaattttgattgtgttgataaccatccaaaaattactaaagacattactaaatcgtcatgataaccttcttcagccgcccaagacacgcctttttcactaaacgttctaaattcttgaatagttgcacggtgatgaataataagcttatctttttcaataaggtcttttaatgtagagcatccgactgctttcgttcgtttagtttgcttcattcctaaatcagtatatgaatcgcaaataacgccttcgtattctaaatccatataaagtgatttagcaactgacacaccagtactatttaattcaatataaactgggcattcattatattctactaaataacgcataacgatgtcaggtagaattaaatgagaaatagtgtttgagtgtaaaacaccaacttgttcccacacatcatcggtaacatcaataatatgtaaagcgtggtaatcttgcccacgaccttctgagcagtctagagttgcaatatattttctatctggttcagggcttttaaatcgatgaaaaccgtgatcatctggagttacttcaatgaaatccataacagctaatttcattcctgaaattaatgtaccggaagtcccttcaaatgctgcggtgtgttcttgacgaaattgagctaaagtagaaccattaatggtttgtatactccattgccatccatcgtcaaaaatatcttcatcattataaagacgttctttaactgaattccaaatagcagtgtatggttcaaatcctgatttaccttcaacagcagcagtccaaatatcataaaaatgatttaatccattaggagtcgtagtaataataatttttgaacgacgaccagatgaaataactggttgaatagcaagccaggaatcatggaagtttggaataaatgcgcattcgtcaatataaatcattgcgaacgagttaccacgaactgcgtctggagaggaagcataggctccgattgaggaaccattatcaagttcaatagaccctttattccattcaacaattcctggctgtaaaaagtcaggaagcagttcaattgcttgcttagtacgatctaaaacttccgcagacattgaacctttgtgcgcaagaatacctacagctttatccttgttaaaacatacaaagtgtgcaagaaaaatagctactacagttgttttaccaagctgacgtgatagattacaaacagtcatacgtttagatgacattattttgagcatatcacgctgatagtcacgtaattgaacctttatgacaccatagtcgatatgagtaatggcgcagtatgtttctgcaaaatatacaatatcatctcggcattttttccattcctcaaccatttcacgagtccattgtgttttaatattagctcgttttaagttaggaagacccatataccgagatcttttattattcttatctttataagtttgaaataattcaggcttatcagaattatttgggatttttactattttgtgtaaacgaagataatcactgaatttttcaggataccattttccatcccactgtgattttatccaatgaattccatcttcatcttttctttctgctaagcttgggtgttttattaaaatttttccagcttcatttaatggatggaaatcatttaatgcattaatcggttgttccatttatcaccttctcacgagcttcttgagcctcgtaagcatcaccaatttcgtccattaattctgttggtgaacccatgaatactgtcgcgttctgaatattcatttgacctgtaggaacagcgcctttagtgccaacctgctcagatgtaatatctttcatatctttatgaagcttcagtatttctctgttcgtcgtagtcatttgccccataagagttgcaaatacttccatgtgacgaggagaatcagcattctttgctgtctcaagaaaaatcttggccgcgtccattagcatttgttgttgaaaatgcatatttcgacgaactactccataatcatcttctaaatcaggagtacggttttgaggattgcttttaacttctactaattgcagaggttcatatactttaatttcctccccgtcgattccggggaggtcagaaatatctaaaagtttgtttatatcaagaccttccataataacctctatgttcttgggccaggaggttctggcggtgttggtctatttacattgctagtgaaagtttgttttactgttccatcccagtcctctgggttaatatctcgaggaacaacttcgctatcaacagattcaaaaacaccttcgccatcaggcaaatctcttgtattggcgtgaaaatctgtataagtagtacgaattaatccttctgcatcatctactggaggatacatccatccgtttacttcaaatgttagtgaccattcgattctacgacgagataaattatctccatctatagcttcatctatagcagcagacatcagtacaattttaatatcccttttaaatggaatatcatttccaaactgttcgtacatagttgtattaaaatgaggttgaaaatatggaagaatctgttcaactatttgaaacatatcgtcttcgtaacgagtaaagatactcaattcataaatcattttaataggagatggattatactgtgatactacagaagttgcgcctttttgcagtaaattctgatttaaaatgtttgttttaaatggagcattatagctaaaatcaactaaatgcaaatttatacgaggtagaatagtttcaaccttggccacatcttcttgtgaatttatcgatgtccatttattcaatttcatcataaagtgttcctttgatgcatacgtaataggaacacgtataaacttatcaccagattctaactgacgtttgatttggatatttgaaaacaaatcgcccatcaaggtagcatatcgtctaaaagacgaattataaaaataaccaaacatgatttctcctaatctgggctttaattagtttataatatttattaatccatgaaatcattatcaaatgggctagattcgaaagatttgcctctgttattgacaacaacataaggttcaacatattctttagcttcagaattaatttgatctacttcagcatactgatcaatattaatgtcatgaataccgttaagattgcgaacaggatttaattctaattcactaaattctggaatgttaattccttcatttttctgtagaactggattaatttcttctccagaataaatgaatttacctgctgtaattttacgaatagcgttttggcctaattgataaaatggatcatatggttcaacccagttaatttcaaataagctgttatccataggaaaatatatcaaatcgccttctttcggttcttttccattaacttggtgtttaaacaagtttggattaatggacaaagtaacttcatcctgtacttgcataccaaagttactaaagaacgatttagctccttcatatccttcaaatgaatttaaatatgcagcgaatttccaagctttagtaaatttattttttaagtcttcgccaaatatcaaatcaggggaaacatactctcttggaacataatagcattctacacctcgcatttgaatgctttcagctactaatacatcagctaatatttgactgtttttataatgattgaaatttacataaggatttagtatttcagtttcattggtctgagaataaccagtgcggttttccaatttagcaaaaagatttttatcataagtagccatattaacctaccaaaattccaaatggaggatcgagcaagtataattcttcacgtaatgcttctttttctaatcgagcttcttctattaagcgttgtccatcaatcgtaacaccgccaggaagcatcataccttgatgacgtgctaaaatttgaccattcaattctttagctaaagctgtagcatagtctttcacccaacgattattataagcaccctgtttaacattcggatcttgaccaacaactcgaccaactaaattgtggtctgggttattatatcgttcagataatgaccagctatcttgtggaccgactgttccatatcctactgtatttccaaccattttattagtattaatgtatgatttagtccagctttctacgataattaaatcatatttttggaagtttcccatgactttgagctgttcatttgctgaattaaaccaaaagtctggaataggagagagcatatcttgcatcattcccatataactggtaagttgagtaaaatatcctaaatcagctccaaaggcatttggtccataaaatctattacaagaagtccccataccgccattaataccagccattcctaaaagaaaatcagtaaaccatggatatgtagcgtttccgtccattgacgttattgatccaatatttgttcgcaaaatgcgagttactgcgaatacatttgaacctcttaaatcgaagactccggttttatatttttcttcgtcatctcctacataaaatacatgaaaacctttgttaagtccatcaaaatggtattcaccgtataattctagggcacgctggatgcaatcataaatttgatcgggtgttaactcaacattgataattggagcccctaaacgtcttagaatgacatctttgagttcctttggattctgagaattatatcctgacatttaaaatcctttggggccctgcggccccatgttatgctggtgataaaaaggtagaaagtagtacccattcgccgtctttacgaacgtaagcttggccatcttttggagcttcaggaatataacctgcttcttgtagagcttgaacgctgctctgtaaagaggatatattgtctttagctgtatttacttcatgcgtgactaccgcaatgttagtttcattcgtttttatagaattagttaatcctcgttcttcaacagttgatccgtcaggattatttccatttataagtgaagtaagttcaataacttgacctttaattcctgttctattatttcctatttcaacttgtatattttgaacattattgtttaaaactgaaacttctccttcaagcactgaaactttatttaatagagatccagaaggagacggttgtcctccgctggagtcagttccaacaatttgatttaaccacgaaacattcgctcttaaaccagacgaagtgttttcaccaacaattccgtttaaagactcaatagaagttgtgtgatttttaatttttcctttaatactagaaggaatatcatctgaacctatagaagtttcaatagccgttaagcgctgtttaacaccttcactctgatttaattcattattaatagcttcaatgctacttttgttattattaatttctgttattatagaaacattttctgggtatccaatagaagatttaatttctgctatatcagaaattattaaagtttgtttatcatctatggtgtttaatctattataaatatttggcccaaaatctactggtttattaccaagttcatcacgtaatttaccaacttcaacagttaatgatcctacgtcagattcagtaaatttattttctaattcacttaaacgaatgccttgtgaagataataatgtactatttgttattattctgtgtttcattcctgtgctagcattaccaacaacaggaagaccgttaatgtcttggccagaatattgtcctaattcctgtttaatccacaataaatcatttctaattgttctataaacagagttttcttcatcattaaatggacctatatcagcaataattttgtcaactgtattattagttccagttaatatatcagtgtgttcactggtaagtgtctttaaattcgatatgtcatttttattaacactgatctgcgatagtgcttctatatctcctgatacatctaaaactccttgaattgttttaatatctttctgtgatgtttcaatggcagttttaagaattcccacattttcatcaagaacttcgacgtttttaaacacggaaacaattggtctattcattgatccatcatttccatacttagtactagctcctaatatttcttcaccatttttaatccatgaaatacgttcctgaccttcgtcaggaacgctatcaacaaaaggtaactcttttaattcaatcatttgtaatccttagtaatgaactttaataatatagtttaatgatatattccatggtctagtttcataaccaattaatccttcacgattaagtgtaccatgagcatctctcggtccacctaattcaaatccatcattagtgaagtatgaagcattatcccagtcggaatgtcttctagttccaagatatccttgataaactgacgcgccaaatgggccttcacttctgttatgttcaccccaaccaccagcatgtttatggtatgacatttgttgtgcctgaacaccaccaacatgcattccgtcacatcctacgcccagtctatcctttccatagccatcttgtccacgttgatttaaaatatgaccgcctgtgccggctcctctgacgaaaagaccccgcatatcaggaacgccaggattattccaatcgccaccaaatcttgttccaactacgtttctataatcaggaaattggtcacctgacacggttccaccatgacacataatccaacctggaggtgctgaatcacccgcaaacatcataatagttccaaccggaactcgttcggacgcatatctttcagtggcaacaggttgatcgccatttttccacattccaccgcgtgaccaaattccatttgctgtaagatggtctaaatttaaagaaccattaatagtttgtccaccacgagtattaattacatctgcgttccatgctaatgctccagagctatcaccttcaggggcaataccggcttgcgtcgttaatttaactactccacgcatagaaccggtagctcctcgaccatttagtgtttcacctgttactgcaacaccacccaaattattattaatttcagtctgcgttcctaggcgtataacacccttatattcatgtgttgcaacagaattcataaaggtatacggggaaattgcatatccttcgcggagagttccttgacgaatttgtgcaacagtagataattgaactactcctctcaccgattctgttgcagtgtcttctgaaggagctatttgcgaaattaattttattgcaagtttttgggtttttagcggagtcatcgcagtagtatcatcaactccagccaaagctgcaggtgtagatgatattttaataaccccgtttgatgactcagacgaatatctatttttgaacacatcgtcagtgtggtatttcagtttttgtggtgttattgatgaattattatctgagccttttaatgtttcttcatttgttgaataacgcgttaaaccatatttagtttcagtagcatttggatacaataatcttgttgctaatgtagctggtgtaacgattttagaattattagttccatctaaaacctcttgctctgacgcaatcattgctattcctttaacttccatagttgcatcaggaataccatttacgccgatattacttatttttgataatgcagactgtactgtcgtaacagtgccaggaaaattcgatccagtaggatcgaatttaacatattttgattcatttgatacgtgctgatatgtattgttactcatgctactctctcaaaataataaaatactgtaggttgtgtgtgactatctagcgtaacagtttgcgcacctaataattgccaagttccatacccaggtttagaaggagaaattatttcctgtttgaaagtaattcctttatcagagtattgttctaagatatgttcttggttatctaaatacttaacttgtattttatttcctatggtaggatggtcttcaaatgaatcaattgcaataaattttacaaccatttcctgtagagctattctaacggcactagtaaattcaattgaagtcattccattagtagctttaactggaataccaaacatgttaacaataactgggtcacctgatttgactgaagtatcagtaacagttccttcaaatgaccaatagtcggtttgttgcacgccagtaggagatacgccgcttatattaactaatacagctccaaccggttgctctgccatatttctaacatcattgatagcagattctacattcgggtcataaaaaccttttgctatttgtgaaattgttacagcgcctactggctgattattcataaccgaaatatcatttttcttagttctaaaaccaagaaaatctgctaagcgggaaataactcccgctttattattaagtaaactcattatgcaatccttatccaacggtatacagtaatagacggttgaatattactaatattagtaggaggagtatgtgaagagtttgttgttgcgtagtcttcacgatattttgtatatataggaccagtttcgtctgggtcatattgacaacctccaataataactgatccgttttcatcttcaattaaaactttttcatcagttttagtcgcaggaagatttgcgttctcaagtgtcaccgatgttgttccaactgttccaccggcagtatgtgaaggatttccgctagaatctaaatcattattgtttaaagcaaagtttggatccgtaacatcatcattccatcctactaaaacttgtcctttaccaaataatttccatgaaccaaatcccatataagtcaccggattatttggatttatagcattttcataaattgaacctacaggataaatgctatcgaaaatagatgatattgaattatacgttctagtataagaatcaactttttcaacatttggccaaccgattttatcaaaatctgttaaggctacatcaccagtaacttcggtagatgatcctttactaacataacggtcatccgttaattcaatgatgtcatctttttctaaaagagttcctaaatcattattgaaccacgttataacgattatatcacctgattcaaattttctatcaaataaaagactaacaggttttccatcttcatattctatagaataatctgtgttagattctttccattcaccaccaagagatatacatcctgcttgcgtatctgagttagcaccttcacacaaaaacagaggatatcctgctgttccagcttgttgttgtaaaattccattaaaacgaacttcaagagaattaggattaataggttctccaggaattaatccaaatgcagagaatggaattgatttcattgttgataaatcagtaacgtaaatacttccttctaaagaagtttttgacgttaattttgaatctaatacttttatttggcgtcttgtatatgaacttctccattgtgatataccatccataaatgtttcaatttgaacagtgtcaccaatattacaaggctgtcttaacctaatattaaatccatcaagaggaatcaattctccttcattttccccaggagagccaaagtcactgttttcactaaatacatcgccgtaatataattcattaccacggtgttttactcggatgttattaacattatagctagttccgcggaaaacatctaaaaagtctgtttgtccttgaacttcgactaaaaattctttacgtgctacattactaatatctgaactaataattttgtcaatttgtttgtttttgacatattcccaacgtcctggagcacaataaacgagctctaaatcactaaattgaatattaatttcaactgacgatgacgaccctttaattgtatccccagaagcagctactaaagtaactggattaatgttccatgttgcaaatacatccctagctctaattactttattataatcattaacagttcctttaggaagttgtaaagttactcttccagaagaggtattaatagcgtatgattttccccacttagcttttaatgtttgaccggatgaagcattataagttttccaggcaccggctgaatatggaacatctccatcgccaagttcataataaagttcatcaaagttttcatttatttttataccacctttacgcaggtagtcaccggtaccatcatcaacaacattaccgatattaatattttgtttcattattgagccaccccgattttctgcgtagcgataactttaactgctgctctcataccgacagttgaagaacttatagttgccgttacataattttctttaatactaaatgcaatattagcgatttcgtcttcttctgtttcatttccaacccgcatgacagcatattcagaagaaatgaccgctgaattaacagtatctacaagaatatttatttctgccgttttaatttttcttccatctactgattggcatgtaactaacaatttagccatgttatattcagtacgatgaaacaatggaatgtcaactgacccagatgtagaaatattccatgtaccttcggccggtgattccttttgaccaaacatactttcaatagaataattccaaaccgacgtagaattatcagatgaaatacaacgtaaagtaactttactatatggactagttactactaaattacctgaaacgcctttaattgaatcaatagcctgaatcgttaaaggattagtaactgatattgatccattagagttaatgaattcaacacaatcgccaagttctcctctttcaataataactttaacacctacagtagaggtatcaatatcatgtctagtgccaactttcactggagttgcgtactccgcgatagagtgcttttgataatatccagtagcatggataatttgaccatctgctccagtgccatttgctactgccattttacgctgatcgccaaacgcattataaattgcgttaaaatcactattaattttattaccaccgtcgaataagatatcaccagtagaagcgttaccaatttcgccggtatcaatcaatttctttggttcttgaatgaacatagcggtttccttatgagtttatagtatttataaagaaaaagggagcccatgggctcccttaatttaaaatgtaaacagaatattgatttcttctgtctgatccattgccatgataataggtggcctattttccatataaatcatttcgcccgaatgcctcattaaatcttctggatcataataatccttttcagctttaacatttgggtcatttgggtcatttggatgagctttagcttcaagaggatttgtgattattgatatttgtctaaatcctttatttcctggcaatgcagcatcaggaaagtaaactgaatctaaatatgctttaaaacggatagtatttgccttaacccggtaaattaatccaaaatcatcttgttgccaagtgagattatcttcatacccccatctagttgggtcttcttttaattcctcaggccaaggaactacgatatattcatttgtgcatctatttatagatacatcgggcggaatctcaaaaagatattcccaaacatatccgtctccaggttcgattgttccttccgcatctcctcgaccttcaggaggagtcattgacctaacagaaggagtccattttccgcctaatttgaggcattcatccttattagttaaagatgctattgaacacattccggtatcaggaacatctaaacaacgatatactaaccagcctgcgcctgattcagtagcgttgtaaggagctgagttacacactacaatatcgttaattctaaatgtgtatggatccggatatctagtatctccccaatctctgcgaggaataacagcatcaagcattgatggaagaacttttactgttcccatcatatgcgtccacatgtcagttacgcctaatacagaatcggttggataaggtggggcaaagcccacctcattttcatttgatgaccacggttctgatcttccaaatgtgataaagatagtgtttttatccggaccacttccaattgaattataaaaattcagcattttttctgttctaaattttgaagtaactatcgcacgatagataacacttgaatcattcatctattttaacctgtgttggattttcagggtctcttggatttcctatattatcttttagacgtttattaactaaatccctaaattgcgcaaatgttgttccagaagcatcaaataggggactcattaatttacgtcgttcagacggcaattgaccttgaaatattgaattattattttcagcattatagtcatcaggaagaggatattctacaccagccattgggccaggctcataaattgcttcgcctgttactgaatcatactcaatttcaccggttggagttaatttagctactctatcagcatattcagtaggcaatccagaatcccatttatagtttttgtatttattaattatagtctctgtatgtttaagagttaaaccaacattaataaacatcgttaaaagggtaattgctataaatccaaatcctactggatgaacaaaacgaataacgtcagatttccagcgggaagaaggtaaattggatttaattttcattacatagtatgatctacttctattaatatagtctatattgttttgaagcaaatcctttcctttaactccacgaataatttcgccttcaaaactagggagtctttctgctttaacttcttgaccagcaattaatcttcccaaaagattatgaatagttacggtccattgcaatttaccattagaataacttctttctatataagtaacattacatcttcctgtggctgtataaatcgtttgtcctactaaatcttcagtcaaagaatcagattgaacgattatgtcatattcagtaccagccccagattcaatttcaatttcaacttcttcattataaagaactttaaaaagaaatttgtatgatgcttcaattcctttagtagaataaaaatcataactacgtgattcaaaaaatcttgcaacagcatcacgtttgtcagcatttaaataaatgtttcttttatatatctctgaccacaaatattcccacgcatgctcttctcgtggatactgattacgaattaaatttcgtaaattattatactgagttccgtatccgtcagaaagatattgaatatatgcttcacaaaatgcctcaaaattcgaatcctgcaacaaataagaatcaggcatcattgtgccaattaatggtcttaaatcagggtcagctaatccatgctcttcttctggcgaccaaggagtctcatgctcttggttttgtaaaaatgcttttaaaaatactccagtcggcttccaaataatttctactgtatctctcacacgatagttaaaatcataataagaaattatttcaccagaagatttataaaaaagcatcccagacgcatattttttaaatcccgtgaatttaacatttggcattactatcgtacaatcaccatcatcccagtattcatgaactaatctatctggtgatgtttccggaatattttctataactttagtgtattttaaatcagcataaactactacagctctattagagtagtttatccagcaccgtgtattagactttttagaccagttaaagaatggttctgcatagtatttcattggctgaggcgtaaaagtttcccaatcagacttttcatctgctataaatgccatcatatgataatgcttatcagctaaccattcacgaggaaattcatatttaacggcaccgattaactgatattttgctacagtttcagggtcattaacaacgttatcatttaaaaatttaaaattactcgaagatagagaaactaatttaccatcagttgacatattcgcatacccaggttgaatacgtcttctttcttcttcagtgttgccaaaaactcttttccacgtttttgtgtcatgatttaaaacatatattcctttatcagcagaatcaattatttttgacgttctaggattagcatttaatgtttcaacttcaccgataataagagcaaaaactttatcaccaatagaatccattttatagcatactgctttaggatttccagttatagtcattgtatcaggttcaaatagcctttctgaatatgttggagataatggatcagaatctataggtgcattgctcgtttttatatatctaactttatctctggcaacaacatagatataatcatccgtacaagtaatggcttcagctatacgatatacattcgctggtaaagtcgcataagtaccaaagatttctacatcaaatcctaaatgtaactggtcgccaagtttagcaaatgttatatcctgcgaactgaatctgacatcatctgctgaccatctaacgtcagtcgatttacggccatagaaaatcttgtcgtatcctagaacgtatgttgtgttcgcagattggtaatatactgtcttagataaaggatatcctacacggtcattgaagagctttacggctttccaggtttgtcctttatcattggatactttaactacaggttgatagcgctcaaaaagatatagaattccttctgattccatcaaataaactcggttaatatccttacatacttgctgaatagaaccttgtatttcatgatactcattttcaccaataataaaattacttattgatgaaacatcaacatacgatgggctgaattgaaatgattcattcatcaatgcagccattatagtgtcattattaaaattgacataattagaattgttaagagtaaacttttcctgaatgaatttattggctaattgcatttcaatcatgttttgaaatgtgtaagcattcgtagcaaaagtttcaaactcttccgtataaacccaatcagattgctcaaaatcttgtgcagctgtagctactctaatgatgtatgatgttagtggatcagcatcatcaaaaaagaaactattgtttgctgtatatcctaaattaatccaacgatattgatcactcgggagattttcccccgagtctgtttttgtctcagcgatttctacaaaatagtagaaattagcaccaacgtcatcccagcgtacttgcatctgatttgcggataacttggaaattctgagactagtgactgaaggtgcttttactgtcattgtgatataggctccaaatcgatagttaagtattgcggacgtaaatcattttcaaatacaatcagtgaaccatcacgggtaaagataacatcatcggttgggtcagaatataattcaatagtctgaacctcaaatttttcagatgttaaattaattttagcgatattccaataaatcatgtcagccggataatttatttcaccgataacatagtatttgtcgcgtccatcagaatttgctaatttattaaaatcattgcctgtatatggctgaatgttttcattttctgtaacatcgccagaagcaaatggaccaataataactttaccaattcctttagaatctcggtctgttgatactatacgaacatcatataatacatcttcttctaaaccagtatcaggatttacaacctttcgtccagaattaaatgaaaacgtattagattccatagaacgatcttttatttgattattgtatttaatacctgcttcaggtgttttatagaagttttgtacttcacgaaccatttgaatagtcgctgatgaaccaatgacagaatgatctgcatcatctacataagttaacatcttagatttagcgaaagacgagttaaaaatttctacatcttcggtataataacgatcaattttatcaattatttgaccttcgagccactgttcggattcttgcagcttatttaaagcatatgtgacttttaaattagtcttaataaaaagataattaggagaaataattgatggcgtaataggagctaaattatagtctttgagataatttttaatatcttcgcgctgtacagtagttaaatacagacctgatttaggtttagcagcaataaatgcataaccaggtttagtagaatcagtgaaagtctgaactgcttgaataatagaaccaaatctctctgaaacgaatgtatcatagtcagtcgcagttacgcagcgttgctgggtttcgcgtttaatagtacccaattcgcggatacgctcaatatcttctggatcaccgccgccatctgccccaacaaaatctgggtcatcgtttggattttcattaatattgatgacagttatatttgttaatgtatctgcgtatgaaaatccgactgctccgttcgcgtcagcaccattagtactgatgtactcaataacaatcgtagagttctgagtaggtttaagacctccgatataattggcagttaaagctccttcagaagcattaacagaaatttcaccttcaccaaaatagaattcagtgtttccatcaatagtttcacgcatatagtaaatcgttgatgttgaaccagcatgaaccattgactttctcgtccagttaatccattccgctccatcaacatataatttaacctggtttctatcaatatttttatcataaatgataataggtgttaatttatcataaatgatttcagttcttactatacgtccctgggccaattttaaacgcggaaaatattggttatttttatcacgaatagcaataacgtcttcggtagaaacgaagttatatggattaacagaagtatcttttgcatatgctaaaaagcgagttccgcgaggaatagtaatgtaattcctattcaatgcgtcggtgcatgttaacataatttcggtctgcgcagcggattttgaagtaggtaaatatccgttatcttgtgcagcttgaacaactgaacttcgtaagttagcagtacgcataaagctttcatacacagcagcattaccaaactgctgaatgtacaatgtattataagccaaaaggtcacacagaacgtttaatcttgagccttcaaaatcataatccaaaaattcattttggccattaagccattcaatgaggttttgttttatttcagcaaacgtacccccgacgaatatctcgggaatagcatttgctgttcttgttaattgataatttacaggggtatttgccattttaaatcctatttaatgaatactttagatgatgcctgagccacagtatcaccgcatgatattggatcagccatttgaaccgctttctttccagtgacatataccttagaagttctaggttgtgtcactccgccatgtgtttcatatggctttttaatttctgtatgttctgtaattggatcacctgctacgagaacagcaattcctccagtgaatactttactttgtgtagcattcacaactgttggaggccatgcttcatggccggcagtaacacacttatcataacttaatcctgacatctatgacctctcatacacatagcttcttaatttattagcccaacgactccaatttccaactatagttttagtataatttttaacgagagtttttcttactggagcaggaggatctgtcggttcagtagtatcagaagatgacctagaattactgccagaacctccagattcactttgttcttggtagtcatatattaatgttacttcgtaagtgaatgtcttctggaggttttgaggagctttccataaatacaactgagtatcagaatcagtaggaagttcttcccatgaagcagcagttttaaattcatcgcctaaacgatatttcaacgcgtcatttccaaatccaaacacagattcatatgttccgtataagcgattttcttctactaaaaccccaggagtttcttcgtaactagttatatttatagatactaacgtttcacctgtttctaattgagcggtaaaggtgacgtcgatagaagaaccttccatggattctcctaaatcagcgctcattggaagtatattagccaatgtcaatcctcgatccatcaattgtgtattgaccagatgaaatagaactcatagatgccattttttctgtccaatcaccaccaacgtcccaatcaactgtcccagcaactttccaagaaagatttccatttactgtgttagtttgatttccttcaactaaagtggtagcatctcctttaactgtaatgtcagcattaccttcaactacaatagtaacattacctttaactaggatagttccattgccttcaacagttttcgtttcgtcgccacgtacaaatattgtattgcttccatctatctggtgaagacgattatccatgttgtaataaatttctgatccaccgacgttagtctttttatcaccggctaccaaaaaattaccatcagcgttggttatatcatacaaattatcaacagtttttcttgttcttcttcctgacggtgatacttcttcataagttccagttggatgaactaatctgtatcgttcttgcccaggggtatcatcaaattcctgaatatgtccactttcagtttccattgtatgcacataaggatattcacctttatatgaagaaactggttctttgaataaaattctcgagtcatttggaataggagggtcagcagggtcagaagatttagctacagtagcagccattgctgatagagacctagctggggttttcacttcaacgccatatgattctaaatttcccgtaagaataatcatggtaacacgggatgcacggccttttgtttgttgataccataatgaatcacgaccggctttatacgctttttcccaatctcctgctaacatagcagttaacattgtgttaaatttagctacaccaccaacacccatctgaaatgccatattttctaacgccatttgacgagaacggttgacagcttgccagactggtcctactttagaatgtgatttaatgtcccgttgcatatcagccaaatcacgttcaaataaagtcgtcgcctcttccatcgtaatagaacctgggtttccagtaatttcacgaccaacttgttttgataaaactttattaatttgagccatatcacgaactggctgcttcatgataagatgaccaataccaattgtcggatatccttcggtatcccaataaacttttaatcttaatccttcatcacggcgaagcatttcagccattgacatatttggattatcatcggttggaatctctgatagtggtctatcatcgggatttattgcagtgtctaagttactatcttggataatgttagaagacgaatcatatcctacttctccgccttggtttaatacattagtatcatttcctaaacgtctaggatattgcccagttgggtcagaaaatccttcaagtctattcggtttttcgcgaactattccaccatacgtgccaaggacaattccgttagttttccatttgtctaaaaaatgaccataaactctagttccttctaccggtccagtaacagaacctccaattccagacattgctgcagaagttataggttgaataactgacatccatggtaatttttcagttggaatacccattacatcgccttgtgctctttgaggtggatgcagaccaaccacacgaacacgaacacgacctaattttaatgggtccattctatcttcaacaacaccaacaaaccaattaaggttattacttatcatttccataagatttctccattatacgtataaggtcgttcataaatgaattaatgtctgattttgctattatttttatttgacgaagtttttcattttcaagaacagcatcttcatacgtattaacagcagcaagtgctccttcatattgaggatattttctagctttatcacctttatcataccaaacatatggattatcatcgtatgatattaaattataaaatttttcaccgttctcattcacatgatatactatttggtctccacctacatttttgtatttttgtatagatgcttgataagctgcttcttgtgaagtaatccatccataatacgggtcataattatcattacacatcaataaaacccaatacaactgtggatttccatatatagtatttgctaattcttccgggcgtggtgaacctttgatataataagtacgtaagcggtatcccgcaagagcgcgtttaaaatagtctttatagtttctaaaaatatctgtcataggaatagtcggcgcgtttttattcaccgttttggccgcatattcaatcggatcaaaaaatgtaaagagcatgggccctcctgtttataaatatattatctatttataaggagaatccaatggcatattctggaaaatgggttcctaaaaatatatcaaagtatagaggtgaccctaaaaaaattacgtatagatcaaattgggaaaaattcttttttgaatggttagataaaaatccagaaattattgcatggggtagtgaaacagcagtaattccttatttttgtaatgcagaagggaaaaaacgtagatacttcatggatatttggatgaaagattcttctggacaagaattttttattgaaataaaacctaaaaaagaaacacaaccaccagttaaaccggcacatctaacaactgcagcgaagaaaagatttatgaatgaaatttatacatattccgttaatactgacaaatggaaagcagcgcaatctttagctgaaaagcgtggaataaaatttagaattctgacagaagatggattacgagctcttggctttaagggggcataatggctatttttcaaataattaatgaaagcactccccaagttccaaaggttaagcaatcattaaacgaaaagaaatggattcagataggtcttgaatataaaaaggccaaagcaaaaggaatgacaggaaagcaatttgctgaagaaagaggaatcaaatactctacgtttacttcagcaatgtcaaaatatgcttcaggaattaaaacggctgaaaagattcaaaagcttgaatcaaaaccaatgaataaactcaataagcaagaaagacaactgcttatgataaattcattcagacaaacattgcgtgataaaattcgtaatgaaggtgcagcaattaataataaaaccagaaagtggtttgctgaaactattaagcaagtaaaaggacataaagttgttcgcccgcagccgggacgaatatatgcttttgcttatgatgctaaacacaaggaaactcttccttactgggataaatttcctttaataatttaccttggtttaggtaaacataatttaatgtacggattaaacttgcactatattccacctaaagctcgtcagcaatttctagaagagcttttaaagcaatatgcaaatacacctactattactaataaaacgaaattaaaaattgattggagtcaagtgaaaggatttaggggtgcagaccaaatgattaaggcatatatacctggtaatattatgggtagccttgttgaaatcgccccgaaagactgggcgaacgttgtgttaatgccacttcagcagttcgtttcaaaaggaaaacgtttctctgcaaacaaagtctggtcaaatatctaattctattatcttccattcttttctattgtttgttctaattggaattgaatggaagggacttagacccattataccaccaacatttataaagcattatgaggaatatatgtcgcaagcactgcaacaaatttttaaccaagcaaatacaactaactttgtagtatcaataccacatagtaatactacatctgcttttactttaaatgctcagtcagttcctattccaggaattaggatacctgttactgataccgtgactgggccgtttggactaggcagagcacaacgtccaggagttacatttgaatacgatccactcatcgtgagatttatagttgacgaagagcttaagtcgtggataggaatgtatgaatggatgctaggaactagtaactatcttacaggcgaaaatactgcccaaaaaacaggtcctgaatacattacgctttacattttagataatagtaaaactgaaatcgtgatgtcaataaatttttataagccttgggtttctgacctgtctgaagtagaatttagctacacggaagattcagacccagctttagtatgcacagcaacgattccttatacgtattttcaagtagaaaaagatggcaaaattatagcagaagtttaatgcttcagtttcatgtgttataatcttaactaaatttgaggagaaacacatgaaactaatctttttaagtggtgtaaagcgtagtggaaaagatactactgcagattttatcatgaataattattctgcagttaaatatcaacttgctggtcctattaaagatgcattggcttatgcatggggtgtatttgcagcaaacactgactatccttgcttaactcgtagagagtttgaaggaattgactatgatcgtgagactaatttgaatttgactaaattagaagtaattatgattatggaacaagcattttgctatcttaatggtaaaagcccaattaaaggtgtgtttgtttttgatgacgaaggaaaagaatcagttaatttcgtagcatttaacaaaattactgacgttataaataatattgaagatcaatggtcagtccgtcgtctgatgcaagccctaggtacggatttgattgttaataacttcgaccgcatgtactgggtaaaattattttctttagattatcttgataaatttaactcaggttatgattattatatcgttcctgatacccgtcaagatcatgaaatggatgcggctagggcgatgggtgctacagtaattcatgtagttcgtcctggccaaaaatccaatgatacacatattacagaagctggattgccaattcgtgatggcgatttagtaattacaaacgatggttctcttgaagaacttttttctaaaattaaaaatacactaaaggtactataatgtctgaacaaactattgaacaaaaactgtctgctgaaatcgtaactctgaaatctcgtattcttgatacgcaggaccaagcggctcgtctgatggaagaatccaaaattctgcaaggaactttggctgaaattgctcatgcagtaggtatcactggcgatactattaaagttgaagaaatcgttgaagctgtcaagaatcttactgctgaatctgcagatgaagaatgatggaatttaaagacttttcaacgggtctttatgtagcagctaagttttcagaattaacacttgacgcgctggaagaactccagcgctctttacgtgttcctaatccagttcctagagaaaaaattcattcgaccatatgttattcgagagtaaatgttccatatgttccatcgagtggaagttttgaagtagcttcttctggacatttagaagtgtggaaaacacaagatggatcgactcttgtacttgtgctagattctgaatatctgcgctgtcgacacatgtatgcgcgggcactaggtgctacacacgattttgatgattacacaccgcatataacattgtcttataatgttgggcccttatcatttagcggtgatgtacaaattccggttgtacttgaccgtgaatacaaagagcctcttaaactcgattgggcagatgatttaaaataatttcacaaagttgtttacatactgatgaggtagtgatactattacctcatcaaaattaattaggaaaataaaaatgaaaactttcaaagagtttgctacaaaaactactatcactgaatcttcccacggtatggaagtaaagcttggaatggctttagctgaagctgagcgtcttttctctcgtattaaagaacttgctgctgcggtcgatccttcatcttttaaaggagaccaaactaaagttaaagcacttttagcattatgctccgatgcaggagaaattgctaaaaatggttctaagatgaagaaacgattagaagatttaaaataatttcacaaagttgtttacatagggttttagttgtgatactattaccctatcaaaacaaaaccaaatggaaatcaaaatgaaaacttaccaagaatttattgctgaaactgctgatgtaaaagttgagtttatttacattggcaagaaagataaaatgggtgaaatgcctcatggagttcttcgtgatgcattagataatttcggtcaactcgccgcagaagattacggtgataaaattgttgttactggtcctgctgcagttattgaaaaatgggcagcagaaaataaatcaatttttcgtaaaaaataagtttacttttagatagggtagtgatactattaccctatctactactgaggagaataaaatgaaacgttgtgaattaattcgaaatgttgctattgcaatttctgcttccgcttttagtttttcaatgtttgttggatttatatgtggattattgactacagcagaaaatgtgttttcacttgtagtagcatttttaattggtttaattgctattgttatggataaaatttctaaaggtgaataatgaacgttgaatattatgtatatgcggattacgaaaataatccgtctaaagatgaagataatcgtttaggtgtagatgctttcgattcccctgcggcggcatggcaatgggttgaaagaaccgatattccttaccgttatattgaagtggttgaccacgcaggaaacaagtatcctaaggaagcatatgttgcttccgggaaggtaaatttccttttgtttgcaggtgataattattatccccgtggtgggtataccgatttaattgctaaagcattctctgaagatgaactccgtgacattatcaaagaaaatgaaaacaaaccgatggattctaatcgctttgattggtggcaaatcgtaaatgctaatactcacactattgttgatgaaggctgataatgattctttatgcgaaagtatcatccattgaaaatggatataaatatgatcaagacgcggctaaagctttgattgatgattatggcattttaacatgttttgaagttgaaaaggtttacattgaccgttcatcttctcaagttaaattagtgaaggaagaacgtaaatttaatacagtaaattttgatttctttattgaaacagaaaaaggtcctcttgaatatgatattttcaagaatcctttgggtcttgaatgcatcgtaaatatgtattattataaatggtaaatatgctttaagaattatttgttattattaactcatatcgcactgattaataccctctatcatcaagggttcttgcttaagagcctttgttaataattgggaattagccaagttggtaaggcactggattttgattccaggatgcaaaggttcgagtcctttattcccagcgcgagaatggccaaattggtaaaggcacagcacttaaaatgctgcggaatgatttccttgtgggttcgagtcccacttctcgcaccaaatttgcggatatcgtataatggtattacctcagacttccaatctgatgatgtgagttcgattctcattatccgctccaatttaatttactccgtgtagctcagtttggtagagcgtctgctttgggagcagaatgtcgtaggttcaaatcctgccacggagactggaggcgtggcagagtggtttaatgcaccggtcttgaaaaccggcagtcgctccggcgactcataggttcaaatcctatcgcctccgccagttttgctgatttagctcagtaggtagagcaactcacttgtaatgagaaggtcggcggttcgattccgtcaatcagcaccaaggccctgtagctggaaggttcaagcaagcgactcataatcgccagatggtggttcaattccacccagggccaccaaattaatttggggagttatcccgtagaggtagcggtgtggactgtaaattcattgtcattgcgactcgggtggttcgactccaccactccccaccaatttggatgtgtagctcaatggcagagcgatcgcctgttaagcgattggttataggttcgaatcctatcacgtccgccaaatttgtgacaactgtcacattaatatctacttgacgcgattataggggttgaactgatcactcttctcttaatttcgtgtgaagacatcttgattgttggagtaggtattaatgtggccgtagttcagttggtagaactcgagattgtgattctcgtagtcatgggttcgactcccatcggtcaccccaattacggggcatagctcagaaggaagagcaaggaccttctaagtcctaggtcgtaggttcgatccctactgcctcgaccaattataagtgaggaaaatatgaaaggtaatgtttatttagtagttcatgatttaacattctattttaatcataatgatactgttatttctgaacgtgtaattaatttgctttatcagcatgcagattatgtttatgtcgaaaacgaatatggtcattggcaatttctcaaaaatcgttcatttggtttagatggttacaaatattttgatcgtaaagaccttttagatacaattccgttatctacacaatatcaaaatcataagtctttacataaatgccggctaattcgaaatgctgaatccgcgtatgaagcaattgatttgtggcgtaaacgccgtgaatatattgattctttaaaagaatattaagaaaccgggtcgctaccggtaagtcgtcggactgatgttccctggagtatagtttcctcccacagttttactgtgttctggctctttactatcacagcagaaacggcgcaccgaattatcgattcgaggaaatatctttgccgtaagccgagtagcgtttttgacggaacgttcggatatggtcgagatatggccttttaaaaatattgagtagcgtcaactacttaataaccgggttcgaatcccggcgtttcgtacaaacacttgccttagcaggtggaaccccgacaaggttgccgcaaggcttagccccgaccgaaaggttggggctttttggtataaatattagtatattaaatctacaaattaaaataggaaataagatgaaatcatatactcaatttttaaatgaagcggtgttaaatgaagcatctagcaccgaaattcaagctgttgcaaaagctgccattgccgcgggtaaatattcctataaagatgcttctgatgaatcgcgattccagtttgcacgcgacatgaaagcggaaggatttacgggaaatgcagttagtatggcctggaaaagtttagttgctactggcgctgcttttgcaaaggcttcgggtaaacctgctcctaaagcagatcctaaagcggcacaagaaaaaaatatcgttaaaggaattatcgctaaatatgaagctatccttaaagagcttttagtaatcaaaaccgaaggccaaaagttagcccgtgcttatagtttcaaagataatccacatgttcactctcttgagtatgttgaagacatccaaaaaattattaaagaccgcatttggtctgctaaacaaatcaaatgacattcttagccccgaccgaaaggttggggctttttagtttgaatcactcggataacgctgttacggatagtaacaaagtaataaataattaataaccaaccgataaattatttcaaggattttaaatgaaaacctatgccgaatttttaaccgaagcagcaaaattaccatctgaagcagatcttactaaagtattcttccaattggacccaaaagaccgcggcgattttcttaagtggaaagctaaagctattgaaatgtacaacatcgataatagttcttttacaatgagtcaagaaaataaattcaataaagcatttttcaaaatttctaagaaattggcatctggcgctcaggttcctaaatctgtgttagctactcctgaacgcgcacctgttaaaatttctaagaatatgttcgacactaaaaaatacgttaatgctttgaataaagctcttgatgcattggatgatgcaaagaaggcagcccgcgatcttcaagacgtgtacaccgattttgaccgcaaaactaaaggttctatttcaaatagcgaacgcaatagtgtaagtgtttattctgatagccttgatgttcttggcgatgcgtatactgaaattaaaaatcgtattaacactgcatctaagctaaaagctgctgcagaagctataataagtaaactaggtaaataattttaaatccctatctaaatgatagggctttttggtatctaggcctttctggacctctctaggcatcatttagtttataccctttataatatattatcctatcctttaattgcccatccctgccctagaattccctaaaaattttttcacaaaactgtttacatctctgttcttccatggtactatacaactatcaactactgatacagaaaacaacttggagaatgaaatggataattacggcgaactgttcaacttctttatgaaatgcgtttcagaagatttcggtcgtacagtgaatgatattaaagttatcggtcctgatcatccgatgtttgaaacttacgcagtaatgggtaatgaagacggtcagtggtatactgtaaaagttgtgattaatatgttcacagcagaaggttatgttaaactgtcttctaaagtttaccatgataacgacgaaatcgcagaagaatatttcaataatatgaaataagtttacgcaggctcatgattgagatattatgagcctataatttgacgatagagtattatactcctacggattttaaatctcaattaacctaaggaaatactatgaacacactgaagaaaattgttgagtttattcgcactaaacttggttctgctatggctaaaaatctatctgtcgaagaacagtatactgctgcagcagcaaaactacttgataaaattaaagatctaaaaactgcttctgttaaatctattaacgaagaaaaacgtattcgtgaacttgttatcgaaaagaatcgacaggccgaatcaaaagagcgtgaaattcgtaaacttctttccgaaggccaagatgtaacaatgcatgctaaactcggtttactatatcgtcgaacagctgagcagttgactactaaggctgacggttatgctgaaatgcgaattgaaatcgccaagaaagtagttgagttagatgatgctcgtcaagaacttgcggttaaattggaatatatccgtgaaactcgtgcagcgaatgcccttggaattagtactgctgatgatgtagttgaaattgcagcactgactaaggttgatattgaagatactcttgctcgagttgaaacctttaatggtaatatttctggggttgaaactacctctgccgatgttcaggaatatattaattctctgaaataatgataaggggcttcgggcccctattacttggagtaaataggaatgaaaatgcaaagtgatttcaattcaatgtttgaagagtttcaaagacaggttgatgttccagaccaattactaaatgctcttaaacgcatggcagaaggacgtaattactattgggggtcttcatatgaaactgatgaaagcctttccggaagattttctagaggtaaaaagtctttaatacgtcctggaatactcattaacagtattgaatcaattcattcattgacgtgtgattttgatgttgaatttactgatttcatttctcctgaatggacggtttgttatttaaacgacgattttgattatctcggtgtttatagtttaagtgacgcatggtttaaacgtaatttacaaaagtcaaatttattttatattgatactactgtaaaatttcagggcaagaaatatttctttactcttatagttgattctgaaacgaagcatgaaaataaacgtattcttagtaaaaagaatatcttaactattgttgatgatctttttgataaatttgtagaaaatcccaattttgaaagtgatttattactagaaaaatttgttaaggaatgtagagaatatgtcaaagccatcactataccttccaagtaaaccgttgaagtatgaattaaagcgtcagataatttctactgatgtgttaataggtcctgttatactcatatcatttgtaattctattgattattggaggtgttttagatgttatgactgatattgattctggcgaaatacttgtgttaatgctaattcttccattaatagttccacttttattagtacccgtaaattgggtaggatactggtatcaaggaaggcattatcgtaaacgcgtacgtgattggaaagcacagtgtaaaaagattaaaaaggaacatcagcttaaacttgctgcgtatgaatttgatgaaattatgaaatttgttaaggaatcacgatgcaaaagccaaaactaaataaagtcaaatattcgttttctgagtcatttttaatttttgctgtggcgttggctgcagctcttgcaggtagtctttttggattgttaattgactgtcttattttaaacatcgacggcacagtaaatataacagaagtttggagtgagctttgttatactaaaattatttcattgttttcattctttggtatcattttatattttcattatgataattttaaaataaattggcaaagaaaaaaagattacaaaatacaattaaaagaatataatagctacatgtcttatattgaaaatgagtcaatgaaagagtttgtgagtgattgtaggaaaattaaatgattttaaaaactcgctggtatgatttagatgatggggatgatggcatttcagttgatagagttgactggaatggttgttccgaagatatgaaaaatttgttgattagggagtttagaatgggatatcaagcagctaagccatttactgtaacagatgataagttcgtatgtattcaaaacggtcgcgctaagttaacgaatgctgattggttcacagataagaaggttcttctgtggtatatcattagtcttcctatatcatcgttcgtattttacttttttataaaaaatccaatggacagaataggagattgggttcttttaactatacttgttaatatttttacagcagcagtattatcaggaatatggcgtatgttcattgaaatgccatggcgtttacgcagacaacaaaagatttttgatgaaaagaaatatgctcaaaatttaaataactttatcactgaatgcaggaaattaaaatgaaaacattatcagctggtattatcttcatgacagaagataaagatttatttatgggtcgggttactggttctcgtaagcctggaatgatggcacatcgctgggatattccaaagggacgtgtagaaagttctgatttgaatgcactggaagctgcaaaaagagaatgcttagaagagaccggttttagcaattataatccagaccttctagaagacctaggtgtatttaaatattctagtaataaagacttacagttattttattatacgattccagtagagcatgagatgtttagaaattgccattgcgagtcttattttgaaaataaagatggcgttatgattccagagatggatgcttttgctcttattcctcgtactcagtggcaatatgtgatgggtccttcactttaccgaataatgaacagcctcttttaatttataaataccttctataaatacttaggaggtattatgaatatatttgaaatgttacgtatagatgaaggtcttagactcaaaatctataaagacacagaaggctattacactattggcatcggtcatttgcttactaaaagtccatcactaagtgttgctaaatctgaattagataaagctattgggcgtaattgtaatggtgtaattacaaaagatgaggccgaaaaactctttaatcaggatgttgatgctgctgttcgcggaattctgagaaatgctaaattaaaaccagtttatgattctcttgatgctgttcgccgctgtgcattgattaacatggtcttccaaatgggggaaaccggtgtagcaggatttactaattctttacgcatgctccagcaaaaacgctgggatgaagcagcagttaacttagctaaaagtagatggtataatcaaacacctaatcgcgcaaaacgagtcattgcaacgtttagaactggcacttgggacgcgtataaaaatctataaagttgtttactttctcctagaattgtgatagtatattcacagttacttggagggataaaatgactcgtattaatttgactttagtatctgaacttgctgatcaacatttaatcgcagaataccgtgaattgccgcgtgtttttggtatagttcgtaagcatgtggcaaacggtaagcgcgttaaagattttaaaatatcttctaaatttattttaggttctggtcatgttactttcttttacgataagttagaatttttgcgaaagcgtcaatcggacattataacggaatgcttaaaacgcgggttcagtataaaagatactgaagttcctgacatcagcgatattccagtagaatggaaaaatgattataatccatgcaaatcagctattaagttgagtcaacaacgactcgatgaaaaaattttaatgaagccacactggtataagtattacggcaaaaatatttacatttaaataacatgggaataacctggacctcatgattctgtgagggattcccgccaacctgtaataaggtcgagcccaagtgcggtaatgggtaaatacagaaatggacaattcatgcgccatggaatggcccaaacctagagagaacaaaatgagaacatttttaactggtccttatctatccctgatgaatgcttttacacaccattctgatgctagagtagaagaaatttgtaaaaacgaatatatcccgccatttgaagacttacttaaacagtattgtacacttcgactagatggtgggcgtcaatctggtaaatcaactgcagtaactaattttgccgctaattggttgtatgacggtggaacagttattgttctttctaatacttcagcttacgctaaaatttccgcagataatattaaaaaggaattttcgcgttattctaatgatgatatacgttttcgtttatttactgattctgtgcgcagttttattggtaataaaggaagcaagttcagaggtttatcgctttcgcgaattttgtatataattgatgagcctgtcaaatctcctgatatggataagatttatagtgtccatattgacactgtacactgctgctgtaatattaaatgttgcattggtggtattactcgtccacagtttttcgtaatcggaatgcaatgatgacagacactcagcttttcgaatatctttatttttcgccaaaaactattaaaaataaattggtgaatcattttgaaattttggcaaataacaacgtcttgagcgaattttatcctaagcaatacaaattacaaaaaggtgtattcaaaggatgcagagttttgtgtactgctcctaatgcaagattaatgaataaaattccatattttaccatggaatttattgatggaccttttaaaggactaatcacccaaagtttaatggcatatgattctgagccatttttaattaaagaacagtcttggataaatttattttctaattgaggttatatgaaagcatatcaaattcttgaaggcacgcataaaggtactatttattttgaagatggtattcaagcacgaattattgtttctaaaacctttaaagaggactcttttgtagacccagaaattttctacggtttgcatgcccgtgaaattgaaattgagccacagcctacagttaaaattgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtacctttactgagagcttgtaatggcaaagataattattgaaggttctaaagatgtgttaaatgctttcgcagaatggtttagtaattcaggcgaacagcaatttaatgaagcgtggaatatgggtgatattagtggaatttatcctacgacagaaatttctgttcagggatatggcattcatgaacctattcgtttagttgaatacgatttatgtactggtgaggaagtcaaatatgattgaagatattaaaggttataagccacataccgacgaaaaaatcggtaaagtaaatgctattaaagacgctgaagttcgtttaggacttatctttgatgctttatatgatgaattctgggaagcactagataattgcgaagactttgaactcgcgaagaattatgctgaaagcctcgatcagttagctattgctaaaacgaaactcaaagaagccagtatgtgggcttgtcgtgctgtgttccaaccagaggaaaaatactaatggctcaattaagcgcagggtttggttatgagtattatactgcccctcgtcgtgtgtctgctgctcctaagaaaattcaaagtcttgatgacttccaggaagtagtccgtaacgctttccaggactatgcacggtatcttaaagaagattcacaggactgtctcgaagaagatgaaattgcttactatacgcagcgtcttgaacagctcaaaaatctacatgaggttcgtgccgaagtttcaaagtctatgaataaattgattagatttaaagaataactgtttacttttcctcttgactgtggtataatttttctatcagttaagaggagaataacatgactatcaacacagaagtttttatccgtcgaaataagcttcgtcgtcactttgagtcggagtttcgtcaaattaacaatgagattcgtgaggcatcaaaagcagcaggggtctcatcgtttcatctaaaatattctcagcatcttcttgatcgtgcaattcaacgggagattgatgagacatatgtttttgaattattccacaaaataaaagaccatgttttagaagttaatgaattcctgagtatgcctccgcgtcctgacattgatgaggattttattgatggggttgaataccgtcctggacgtttagaaatcacagatggaaatctttggcttggatttacagtttgtaaacctaatgcgaagttcaaagacccgtcgcttcaatgcaggatggcaattatcaatagtcgtcgtttaccaggaaaggcttctaaagcagtaattaaaactcaatgaggtaagcatgagaaaagcactactcgctggtctattggccatttcaatgatggcacatagctccgagcatactttcagtaatgtccaactcgataacatgcgttacgcgtatcaattcggggaacaattttctaaggatggaaaatataaaacacacaaaaatatccacaagagcggattaggtcatataatggctgctattttatggcaagaaagctctggcggagttaatttaaaatctaaaccaaagcatcatgcctatggaatgttccaaaattatttgcctactatgcgagcgagagtcaaggaacttggttataatatgaccgatgctgaaataaaaagaatgttgaataaacggtccaattcagcttcctgggcgtacattgaactttcttattggttaaatatacataagggcgatataagaaaagcaatatcctcttataattcgggatggaatgttaaagctggttctaaatatgcttctgaagtcctagaaaaggctaattaccttaaaaataataaacttttggaaatagtaaatgactaaaattttggttttatgtataggattaatttcattttctgcgttagcagatacatcatatactgaaattagagagtatgtaaaccgtactgccgcggattattgtgggaaaaataaagcatgccaagctgaatttgcgcagaaattaatatatgcatataaagacggagaaagagataaatcaagcagatacaaaaacgatacattattaaaacgatatgctgctaaaaagtggaataccttagaatgttcagttgcggaggagaaagataaagccgcttgtcattcaatggttgaccgtttggtagattcttataatcgaggattgagtactagatgattgtaaaatatatcaagggcgatattgtcgcccttttcgctgaaggtaaaaatattgcgcatggatgcaattgttttcatactatgggttcaggcgtagcgggtcaattaaccaaagctttccctaaaattttggaagctgataaattacagactgaatggggtgatgtaactaaactcggttcttactcagtctatgaaaaatactttaggactcataaagcgtattgcttcaacctttatactcaatttcaaccagggccaaattttgagtattccgctttaatgaattgtatgttagaattaaatgagtttggtgaaaataaactgattaaacctacaatctatatgcctaggattggtgcaggcataggtaaagggaactgggatattattgaggggattttagatacatattcctctaaattagaaattgtgattgttgattgggaaccgttattatgaatatacattatccacatccatatgacccaaagaataaggcagtaattattcgtcaatgggaacgcatttgccgtactaaatgtccaattaatagtccgcatgatgtagataaagactacattggaacattcgttgaatatacctttattgataagaaaggtcgtaaacagcatgtagaagaatactgcttaaaggttacatggttatgagccaaactagtattcttaaaaatgcccattgtgaaaagtgtaaatggccagttgtttttgctttatgcaacgatgaaatggcttgtgatttcgattattggtgctattgttctaataaaggatgcatcaatcataaaggtgaaggattttattcgggattttatccttatccagatttcgttaaagaaggtaaaccgaaatgaatagttttgagttacagtatgaagtgttacgtgagcttgataatttaattgaactcgctgtcaataaaggttttgccattggaatcggtcaaaaagatactggtcatttaactatggaaatatttaagcaaaagcgaattattttaaaactcctggaaattaatatatgagtctgagtaaagaacaaaaagataaattgtttgagcttatccatgaacttctagatgagcatacagaagcaaacaccttttatgatgaatacggcccgctatctcccgaacagcaagaagaatttgctgatcggtttgataagaaagaaaacgaattaatagcttatgtgaatatgctttaagaaggtgatatggcgagtttaatttttacttacgcagcaatgaatgctggaaaatctgcttctcttttgactgctgcacataattataaagaacgcggaatgggtgtattagttcttaagcctgctattgatactcgcgattctgtctgtgaagtcgtttctcgcattggaattaagcaggaagcgaatattattacggatgatatggatatttttgagttctataaatgggctgaagcacaaaaagatattcattgtgtatttgtagatgaagctcagtttttaaaaactgaacaggtgcatcaattaagtcgaattgttgatacatataatgttcctgttatggcttatgggctaaggactgatttcgctggaaaattatttgaaggttctaaagaacttttggcgattgcagataaacttattgaactaaaggcagtttgtcattgtggtaaaaagctattatgacagctcgattaatggaagatggaacaccagttaaagaaggtaatcaaatctgtattggtgatgaaatttatgtttctttgtgtagaaaacattggaatgaattaactaaaaagctcggttagtgcaaaagttataaataggtttatctaactaaaggggtatatatgctacaattaactgaaaagcaacttcgcaatcttactgttcttcaattagatgaaattcgtagggaagttggaaatatcatttcagctttgcgtcgagaagtatcactcaaccaatctccggcagactatactagattgcgaaattttgaaaaataccttgataaagttaaggccgtgcatcggcataaagtaaatacaggacaaaaatgataggaggcctttatggccttaaaagcaacggcactatttgccatgctaggattagcgtttgctttatctccaccaattgaagcgaatgtcgatcctcattttgataaatttatggaatctggtattaggcacgtttatatgctttttgaaaataaaagcgtagaatcgtctgaacaattctatagttttatgagaacgacctataaaaatgacccgtgctcttctgattttgaatgtatagagcgaggcgcggagatggcacaatcatacgctagaattatgaacattaaattggagactgaatgaaattcagcgacttttcacaaagtggaaaaccttcaaaggcagatgaatacttaggtttattaatggctgcacaagcttattttcattctgcgcattttgaaactaaaagttatgctagacacaaagcatacgattttattttctctgagttgccagatttgattgataaatttggtgagcaatatttggggtattctggtagaaaatacacgccttctattccagatgccagtaaacttcctaccgacacaattaaaatgattgatcgcatactagaccaatctaacagcatttataaagaaatgcctccagccattcaaagcacgatagatgatattactgggatgttttaccagagtaaatatcttctttccctcgaataacattagtctccttcgggagacttttttcattttaccggtttactttccatttgagctgtgatactatacaactatcggataaagaggagaacatcatgaaaattgaagcacttaatcaagaaggaaatatctacgtcatcattaatggtgattttttcgtcgacatggatgaagttactagtgaagaacttgtagaacttcttaagaaacgttatgatatgtgtgatgaagctgcaactcatatggcgtgtgcaatattctctctttcatatgtggtggaataatgactagaattgaacaagcagataaaattaaagaattggtagctttaattcgcaaagcagatgaggaacttagtgactttgcttggttttcggcaggcattgcaaataaaggtattgaaaaatttgaagctaaagttgataatgctttagaagcgttagatatgtttcttgatgaaattatcgatcataatacgagagtttaattatgctaacacgtgaacagtttgaaaaaatcattaaattagcacgtgatattgaaatagattcataccaattagcagttgagcattgtgaaggatattcatacgacggtatagaagcagctaaaaaggatttggataaatccaaagctaagttagttcaatatcttgaaatgattaggtggaataatgaaaactgaaaagcagatgtttttaatgaagctaattgaagaatatgctaatgcagtttctgactatgagtattctgctcgggaaagaggtacagctttcgcaaaggaagaaatgaaaatcatggttgatgctcacacaaagcttcagaattttattgaaaacgtcatttaatggtttacaagttgacaagattatgatatagtaatcttgtcaactgccaaggagaagagaatgaaagttttgtttgttgtgtatgtgatgattcaatataattatccaatgtttacttataatctggtgaacaacattattgatattattcaaaggagtatgtaattgtgggtgagtcgaagagaatcaatatgaaacgattagtattagaagttagtccgctttttggtgaattagctatagaaaaagtaaataatatgtatcgtttgacacaagaagacgatatgctatattttacgcctagtgaaatcattcatttaacccaaattgaatatccttatactgataaaatagtaagcatcaatgatgagcacaaaattcatttttattcttcatgcccaggatttaatattaaaagtgagtcaatgtgtttatcagttatccattgggatagctttatagctaagattaaatatttttattattctaatgaaagaaaacatagtttaaaatggctcaaaaattgcaatgctattattactaacgcttgcaatcagaatgatgaaactgttttaaacgtatcaaaatgctatgaagatggtgatgtcttaactattcgtcaaattgatgattttcgatcgtatattgtcacatttaccaaagacgaagctattgcgctaaagacttatctcgattctgtcattccaactatgatttcaaagtgaggaaatatgtttatttcaagtggaagtggtttaattcgtgttgaatttaaaaatgacatcttccttattcaaggagatgatattattaaaatgagttatgatgaaattaagaaaatttgtaatgctcttgaaagtcatggaaaagtgaacgctgttattgatattggtgatttatgggtgacactttatgaagtatccgaaggatttaatattgaagatgaaaacaacatcttagctattgataaaagaagcgatttgtttgatgtgttaaaagtttatgaacagtcaaacggtggaagaaaagctgtattgatttatcaaaaaccacattcatgtggaactgcttcaatcatttcagatattgaagatgaaactgatacttatatgtgtgttttaaaagctggtggtgaccgtcatccggattttatttctattcgtcaaaacaatgaagaaatttcattatcaaaatcagaagctgaagctatgattaagtatttaacaactgttacaccttcaatgaaaggataattatgattattaatgaaaactcttggcactataaattattcaaattgtttaacgatgaatggcaacgacctaagacgctgtgcgcatacttttggtctattgttatccctacatttttcgtttcttttttcggatgtactatactcgtaggtctaactatcatctgcgcagaaatcatacagaaatggcttatttttggtagtttatggactcttattccatcagcatttatacttgccattttgcttgttttacttattgtcggttcatttgttattcctgcacaactgcgtgaaaaatataaagattataaatggaaaaaggattatgctttacacgtagaaaatattgatagggcgtataaaggtttacctcctattcaacccaagaaatcgattatcgttgaatttttaaaagctcgtaaagctaaagtatgtcctgttattgaatataaggctgaatgatgaaaacagtaatgaaaagctattttggtagtcatctttatggaacttctaccccagaatctgatgtagattttaaagaaatctttgttcctcctgctcgtgatattcttatcggaaatgttaaagagcacatgagtaaaaacactaacaacacatcatctaaaaacactaaagatgatattgaccatgaactatacagtcttaaatatttctttaaattagcagcagatggtgaaactgtagcgttagatatgcttcacactccacctgaactagtggttaaatctgatttgcctgatgtgtggaagtttattcaagacaaccgttctcgtttttatacgactaacatgaaatcctatttaggatatgtccgtaagcaagcttctaaatacggcgttaagggttctcgtttggctgcattacgtgatgtattgaaagtagttaatcaaatccctgagcaatgggttgattaccaagaagatggttctattaagcagcgtcgtactaaagttgaagatattaagcatcgtcttccagaaaacgaattctgtgaatgggtgttccataatcatgagaaaacaggcccacagacgttctacacagtgttgggtcgtaaatatcagacaacgctttctcttattgagcttaagcagtcactgaacaaattagatgctgaatacggtgaacgtgctcgtaaggccgaagccaatgaaggtattgactggaaagctatgagtcatgcttgccgtggtggactccaactattggaaatttacaaaactggtgacttggtttatccactccaagatgctccatttattctcgacgtgaagttgggtaaacatccatttaaaacggttcaagagtttttggaagatgtggtcgatcaagtagaagcagcatctactgaagcttctaagaacggtatgcagcaaaaagtagacatgggtttttgggatgacttccttgagagggtttatcttgaaaaccaccgaagttattataaatgatagggagccttcgggctccctttttttatttcaaaaatttttcacaaaattgtttacaagcataaagctttatggtactatacaactatcaactgatacggatttggagaataaaatgaaaactgtaactatcaataagggtatctacttcggtaaagaaatctctggaacttttgagctcttaggtgaatggttcccagataatgctccggtagatgcacaaggagatggtaaagtttttgttgaaattgacggtaagcgtcgcggtgtttgggtttacaaatcagacatttcatatgatggtgtaaaagttgaagaagttaaagaatcgtatgaagatatgaaaacccgcattaataaaagatttaatgttatgggaatgatgacgaatggtattattaacggaaacattcgttcattaattatctctggtgcggcgggtattggtaaaacgtattctttagataaagctttaaataaagcaaatgatattggatacattgaatataaaagcattaatggtaaaatctctggtattggtctttatgagcagctttggaataatcgtgaagagaattctgtacttttgattgatgatgtggatgttttctctgatatggacattcttaatcttctgaaagctgctctggacaccggagagacccgcaaagtctgctggagcactgcatcttcttacttagaagaaaaaggcattgagcgtgagtttgaatttaaaggaacgattgtttttatcacaaacgttgacattgaccgcgaattagaccgtggtactaaacttgctccacatttacaagcattagtttcccgctcggtttatttagatttgggtgttcacactaatgaagaaattatggtcagggttgaagatgttattctttcaactgacatgatgcaaaaacgcggtctttctgatgaagaaacttataaagcattatcatggatgaaagtcaatgttaatcgtttacgcaatgtttcactgcgtactgcactttatcttgctgactttattatgaccgacaaaaacggttgggaagaaatcgctgaggttactcttctgaaataattcataagaggccttctatgacaaaaaggcagttcagaaatagattatatggactgccatcaaaaagatgattagaattaaactggtaaatggaggtagtgatgttatactcaaaggctcgtgaaatttacgaaactaaaattaaagacgcggttcatcagttcgcaacgacaatgcgttggacaaatgactgggaatactccaagaatcataagaagcccttggtgacaagaaaggctcatatgttagtgttaatagaccgtgagcagattaaagcccgagaagccctccagaatcataaaaaggctgcctttgaatggtttatggataacactgctcctgagactaagaaagcggtaagcgcatggttcagtggaaaaaattgtgaaagaagtttcttttagtggtttacaagactgttcctctgtggtactatacaactatcaactacggaggaacacaaaatgaacgctaaagatattttcaacctggtaaattacaacgatggtaaatttaaatctgaagcacaaagcaagttctttaatgacatctcaatcggaggtgaaatcacggttgacggaggacaaatttacaaatctcgttggaattggatcgttattatcgatgagattggtattgtagaaatttacaagaatacgaataaaaatcgtacattacactggtctcgtgatactaacgaacagtacaaaaaggataaagcatctaaattatctcgtgtaactcaagaagatattgagttcatcaagaaagatattttgatgtatgataacttaattgctgaagagcaagctgttattgataaatttgatgagattaaagcttctcgtgaaattcctgattttatgaaagaatcagtaaatgaacgatacactctcatttcagagcgtattgaaacttacaaaaagcaaagagctgaacgccaaaatactcttcggaagtttgaagaacggttaaagacggtactcgcataaccgctttataccaaggatggtataatggttctaagcccttttaattgagattattatgaaacagttgataattaaaagattgaatttattgatatgttgtttatgtgtagtagttgcatatggttattacgcaattaatgattatatgcattataaagattatgatgttactgtagttaatacctttacaggaactcaaggaaaggggtctagtttatcgtttattgctgtatatgaactcaaagacggttatagatttagcgaatatatttcaccagagatgtattcatcaatagaaaaaggcgataatattactgtaagtttacgtcctttcgacgtaaaacagacattgtttgataatattgtttggttctttggaatggtattagttcaatctgtgtgtggtgcttatatagtctgttccatcttattctgtatatttagtaaaattgaaattgagtgaggaaaatatgtcagtagtaattaataatgtcaatgcagtaattaaatctttagttaataaaaaattgaatgaatggactgtacttcgtcgtggagagccagataaattttttcatagatttaacccaactttggatttgaatgttattgacagagatgttcatgctgaaattttagataaatttaaagttgatattgggtttggattagataaacatttacaacgaacaaacgggtctggaatgggtttatctaatcgcatcatgaaagcccttaataaaattggagcgttgtctcgtattaatgcgagtgaaatccttcgcaattataataaaggatatgacctttatggtcgattaatgccgaaattatcatttgaccaaatgatcgcagatttgtgggaaaatcaacgacgattattagcattaggcgctcgattagctaaaggtctagataaacaaatgatttttaagaccaataatacagaagaccttaaatgctttaaatttagtattcgtggcgatgattattatatcagagctcactctacagattatgttaatatggggcatcatctctgtttagcttttgaagttttaaaagaagccggaacattagaatattcatctggtgcaaaatgccctattggttcaagttgtattttaatttatcgcccggatgaatccagttcaactaaattgcctacaaaacctgtaccagttcgtagtaatgaaaaacattctgagcaaattgattattttaataagcaaattgaagagctgaatatttctattcaacaatatgatgatgaaattttcagactatctggactgagtagtaaagctaaatctgagcgtgaaaagttaattaaaattatcgatttacttaaatcttaaggaacaccatgaaaactcgttctcaaattgaagatatggttcgtaatgccagctatactcgtgatgctatgacatttttgtgcgaaaataatttagaccttggtaaagttaattgttccattcacgcctttaaacatctgaacagcagtgaatgggtgcgtaattttaatgaagctgggtatattactcaaatgactgctcgtgaacagctcaccgatttctgtaaaactattgattataaaaatcctctatttgttcaaggtgttggtcagagtaaggtcgatttatcatctggatttttcaatccaaatcattatcgtattgaatggagatttattgctctattccgtaaacaattaaagcaaattttgtctactgctagtcgattaaaaggttctgatattaacttaaagaatctgaaatttgatggttatactcttcagatggaagtaagaccattaaaagaaaataacagaactgcacgaattagctttaaacctaatacaaaaaattctctttcaatttgtgaatgccttaaatcacagttgacagaagcatttaagtatatggatgtagttgccgcggttcagtctaagattttacctcattttgagcgaaattgggaacatacaacaacgtatgaacttgatatgatcgtttcatttaaatacgattttttgagaaaggacgaagtcccgcaagagaaaaagcaggaagtgcaagatatcttaaatttatccaattactcatcaaacgatcctaaattttggatgtatagttcaggtaataaagatacatggaaattcaataaagtgaattttcttcctgttgaaaatccgagtcttaaacctgttgaaaaatggcacgcggatgcgattgagaagtctatcaaggcagtagatgatgaactcgttaaagcaactaatgaagtgttagaagctgaaaagatgctagaaaaagctcaagaaaaagtcaaaaatcttacgaagcaacgttctaaactgaacaacgcactaaatgcactaaactagtttactttgccacaaggatgtggtataatgttcttactttctactgaggagattaatatgactcgtaacgaatatatcaaatcattcaatagcgttattgatgataaagttaaacctgtgtttagtcagaatagtgttatttccattatcaatcaatggctcaataatattgatgcaagtattgtttcttcaagcaaatttattcatgaagttcataaaatttctagtcgcgaatataaagatgatattaaggaaacttttaaaggttctcgtcttctttcatatttagttaatcaagatattcttggtaaatttgggaaagaaattaaacgaactaaagatgtagtaggatacagttggttcggtgatgttaattcttatcatcttaataataaagaagaccctgagaatatttttactcgtcgttggattagtaattttagacttttcaagaagcaaattctaaaatcagcttctaaattatgctatggtgattatcgtcaaatccatccttgggcttctgatatgattatcataaaagaatatgagcttgataaaaataaagcagctatttttgtgaattatgaattttttacaccagaagctaatcaaaagaacattaataaatttttctcaattgctagcgatataactcgtcagttagagaccgcattactttgtatggaaacagtagaaaatattcatacttatccttttaagaatatatgcggttgggaaggatataaaattgtagttagtctccgtgaagtaaagtgtgcgtactcaccgactgataaagaaatttaccaacaaaaatgtgatgaaattgtgaatactcctaaagaagaaactacccttgaggaactaatggaatgtcttgacgattcgcctgaaccagtagaaattcgtccagaagttattgcactagaaaaagcttataaagaagttctagaaatttctaataaagcgcagaaagaatatgagcaggctaaaaagatttgggaagaatccgttaatcgtcttgatcgtcttgaacaagctttacagttaattaagtaatttaaagccaaggatggctcggagtataaaccattaaccaagtgagaagaatatgaaaactcgtaaacattatattgattattttgacagtcttattactaaacaccgtaattatcagatcgggcacagagcagtaatcaataatattcttcgtgatttccttcaatatgttggtcaggaaaatcatatctgtaaagatactcaaaacgcttattctcattcgttaggcaatttgcttgaatggtttaaacgttctcgtatgttatcttctactgtagctcatgagaacattaaaaactttatgaagccgagcttcattaaatctgagacatctataaccgatttggttgaatttactattgttaatgatgttaaaaagactcatttggctgattggttttctaccattcctgaaactaaatttgctgataaatttgcttgtcaattcaatgaccaagtgaatatgctttttaagcatgctcgcaaactatttaccgcgggcgatgaccgtacaaatacagttcatgttaaggactgggttattgctgatgaagtaacacacaagccaggtggttcatcagtattaattaatatccaggttccttattattactcacgtaatcttggcaccatgacagctaaagaaattaataagcacaacaaaactattcgttcgttgtcttataaactccgcatgatgttaaaaattatggacgtagtggaaatgtatgacgaaaccgaagataatggttcaatgttatacagttcacgcattctaattaaactgaagaaccctaatacatataagacagttgtaaaagagcctaaagtagaaaaggttgataatctgagtgaagaacgtgaatatctcaatgcccgtttgattgaagttgaagcccaaattgcagaacacaccaaattgttaaaagctcttaatgcaaaagcaaatggtttacgtaatgctattgaggtattgaaatgaaaaagcgtttattagaagacattgcagcttcaagtaattccagtttaattaaaattattatggctggtgaggaagatgatatggaaatgcgtggaaagattcacggctgcgacgatttagattttaaacctccagcatgggatgctattatggctatggttgaacgacgtgaaagagcttctaaaaacgttcctaattgccctgaatgcggtactgaacaagttcagttgattaactggcgtaaaccagagcttgaatataaatgccgtcaatgtaaacataaattcagtaagcatgctccggaaatggttaaattgcctgactctactgagttctttaaagaacttgtgagtgttcaaccaatgcctaataatattttggattaaaaatgaccaagcgtaaagaatatatggaggctgctgaaaaggcagtccgtgaattagcaatagcttattataatgaacacggtaaatttcctgatagatacagcgtgcttaaatctgctttaactcgttcatataaaaatatgctatcagaagtaagtgatattatatacaaacataaagaacaaacgggccaaagtcttgattacgacgagacttttaaacaagtactaggaattaaggaataatatgtttaaagtatatggttatgatagcaacattcataaatgcgtgtattgcgataatgcaaaacgtcttttgactgtgaagaaacagccgtttgaatttatcaacattatgccggaaaaaggtgtttttgatgatgagaaaatcgctgagcttctgactaaactaggtcgtgatactcaaatcggcttgacaatgcctcaggtatttgctcctgatggaagtcatattggtggatttgaccaactgcgagaatattttaaatgatgctcgaaggaactgactatattcatgattaccgcggaagcgcggtatatgtaggtgatgaagttgcagtttattatgggtatggaactttgatgacagccaaggttattcaaattaaaaataatcgtgctaaactcgaagtttattattctaatggcgaaaagtctatttctaagtggaaatacggcgattgcatggtcaaactggggtaaatatgatttacgatattaatgtatcacgagctccgtcaatggttactattccagccgaagaactagatcgtcttcagaaaattgaagaacttctttgggaaattgaatgtgacctgccatcaggactagaatcttggattgattatgaagaacttaataagcttcggggttaaaccttggtgggcggctagatgggaaactgtagagccagagccggaagaaccggtttacactgatgaagaaacaatatataatgaaccaacgataaatgacttaattgatatggagatgggacatgattacagtagataagtggtttagaattaatcgtgctgatacagggctgtgtaattactggccggaacttagtgcaggtactgtctttaaagttcgtgaacttgcaaaagaatgtgaagatgatatagagcctgatactggaattattgaaattgaactttccgacggaaagattattaacatctacgataagccaattacgtattggtgcttgtggaatactgaatccattgaaaatggcgaaattgaagaagttgtagagcgaactaatcaagttgttcagaagcctaaagccgattttcaaggtgaacgtatttcatacgcattagctaaattagctgcacaagaaaataacgatggctatgaaggaaatttgatgcaagctgcggcagaatatattgaatggcttgaaacccaaatttctttttctgaccaaaagattcggcaatataagcgattgaatcaaatgttttacaatacttgaaaataataaatacccttatctatttaaggtaagggtttattatgttattgactggcaaattatacaaagaagaaaaacagaaattttataatgcacaaaacggtaaatgcttaatttgccaacgagaactaaatcctgatgttcaagctaatcaccttgaccatgatcatgaattaaatggaccaaaagcaggaaaggtacgtggattgctttgtaatctctgcaatgccgcagaaggtcaaatgaagcataaatttaatcgttctggcttaaagggacaaggtgttgattatcttgaatggttagaaaatttacttacttatttaaaatccgattacacccaaaataatattcaccctaactttattggagataaatcaaaggaattttctcgtttaggaaaagaggaaatgatggctgagatgcttcaaagaggatttgaatataatgaatctgacactaaaacacagttaatagcttcatttaagaagcagcttagaaagagtttaaaatgacaattgaaaaagaaattgaaggattgattcataaaactaataaagaccttttgaacgagaatgctaataaagattctcgtgtttttccaactcaacgggaccttatggctggtattgtgtctaaacacattgccaaaaatatggtcccgtcttttattatgaaagcgcatgaaagcggaattattcatttccatgatattgattattcccctgctcttccatttactaattgttgtttagtagatttaaaaggaatgcttgagaacggatttaagcttggtaatgcgcagattgaaactcctaaatcaatcggtgttgctactgcaattatggcacaaattactgcacaggttgcttcccatcaatatggcggaacgacttttgcgaatgtagataaagtactttctccttatgttaaacgcacatatgcaaaacatattgaggatgcagaaaaatggcaaatcgctgatgcgttgaattatgctcaatctaaaacagaaaaagacgtatacgatgcattccaagcttatgaatatgaagtaaatactctctttagttcaaacggacaaacaccttttgtaacaattacatttggtacgggaactgactggactgaacgaatgattcagaaagcaattctgaaaaatcgtattaaaggtcttggtcgtgatgggataactcctattttccctaagcttgttatgtttgttgaagaaggtgttaatctttataaagacgatccgaactatgatattaagcagcttgctctagagtgtgcaagcaaaaggatgtatcctgatattatttcagctaagaacaataaagctatcactggttcatctgttcctgtttctccaatgggttgccgtagtttcttgagcgtatggaaagattcgactggtaatgaaattcttgatggacgtaataatcttggtgttgtaacactgaatcttcctcgtattgcgttggattcttatattggaacacagttcaatgaacagaaatttgttaaattattcaatgagcgaatggatttatgttttgaagctttgatgtgtagaattagttccttaaaaggagttaaagcgactgttgctcctattctttaccaagaaggtgcattcggggttcgtcttaaacctgatgacgatataattgagttatttaaaaatggtagaagttcagtgtctttaggatacattggtattcacgaattgaatattcttgtcggtcgtgatattggacaggaaattttaactaaaatgaatgctcgtcttaaacagtggactgaaagaactgggtttgcttttagcttgtattctactcctgctgaaaacctttgctatcgcttctgtaaacttgatacagaaaaatatggaagtgtaaaggatgttactgataaaggctggtacactaacagtttccatgtttcagtagaagaaaatattactccgtttgaaaagatttctcgcgaagccccgtatcatttcattgcaacaggtggtcacatttcttatgttgaacttcctgatatgaaaaataacttaaaaggtcttgaggctgtatgggattatgctgcacaacatttagattattttggtgttaatatgccagtagataaatgttttacgtgtggaagtacccatgaaatgactcctactgaaaacgggtttgtttgttctatttgtggagaaactgatcctaaaaagatgaacacaataagaagaacatgcggttatttgggaaacccgaacgaacgcggatttaatctcggtaaaaataaagaaatcatgcatagggttaaacaccaatgaattatgacagaatctattcaaatctagttaattctgctgaacacccatctaagccccgtcaaactaaagccgggtatgaacttcatcatataattccaagaagtatgggtggttcagatgatttagacaacttagtatttttaacttataaggcccactatactgctcaccatttattggctaaaatatatggtggaaagatgtatgatgcatattggataatgagtaatagtaagcatagaaaagttacttcttcacaatacgcgtatgcaaaagctaagaaatttgaaaatcagcgtggcgcaaaaagaagcgataaaactaagaagctaatgagcatagctaggtctaaagtaactcttcctgatgattttggaaaaaggatatctgatgggctaacaggaagaactttgtctactagtcataaagagcatatcaaaaatagttctagaaatcgctttaacaccaaaacggttattggctattcaccagacggaaatacaatagaactaactggagcaactgaaataagaaatgcaggattttttcattctgctgtttataaatgttgcaaaggaattcaatctattcataagggatatacttggaaatataaagatgaattatgatagaatttatccatgcgatttcgttaacggccctggatgtagggtcgttctcttcgtcactggatgtttgcataaatgcgaaggttgttataatcgtagtacttggaatgctcgtaacggacagttattcactatgaataccgttaaagaacttgcgtcccatttaagcaaatcgtatatccaaggccttaccttaaccggtggtgacccactttatccacagaaccgagaagagatttcaaatttagtttcttgggttaaagcaagatttcctgagaaagacatttggttgtggacaggatataagtttgaagatattaaacaactagaaatgcttaaatatgttgatgttattattgatgggaagtatgagaaaaatcttccgaccaaaaagctgtggcgaggatcagataatcagcgactttggtcaaataccgatggggtgtggacacatgattaaattgaattacattatggatactataaatgatatgatttttcattttggtccagaattttattcgcagtatagtttagtgcttatcaatgcttggttaatcaattaagggtaaaatatgtataaatttcgtaaaggtttagctgattttcttacaactgtaacgttctttctgtttatggcagttggagctattttccttattccttttattgctatatttttcgtgattagtttgatttctccagaaaagagtttatcttctagcgagttcaatgagcgtctggataaaattactaacaagctgaattctgttcttgataaaaaggcttaattatgattagttttgagcggtatgtggtagagagttggaagggttttgatatgttcggtaatgactattatttttacgaatgtagtctaaatcctagtttttgggctggacgtgaacgagatctcgaagaaattaatgctcgtgccgaattgttaggtgaactgcctacggtttattttacctttgatgcatctggatttgttatccaggtttattttcctgaagaaaactctggtgaggattctgttaacccgccatactgggcttatcaaggaattatttctcgtggaacaaaactcgaacttaaagaataagattgaaatctatggcatccccgaagaagtaggtcgttgtcctggatgtcaatcagttacaaaacttctaaaggagctcaatgctccttttactttctataaagttcttacaaataatggtaagattgagtatgatcgtccactgattgtatctcttgctaaacgtgctggattcacatctcttaacattcgttatccagtcattttcattaatgattctagacaaaagaacattaaacacttcaaagaaactctcatttcacttggatatgatagagatatcatagaagattaagacgggccctctgggcctttctttctcacattctgtatattaccattctaagttatcgttcccttcttatcattccctaaaatatttttcacaaagttgtttacaacaagttcaaaccgtggtattattaacatatgaattgcctttgaggaattgatatggttgataaagagattaaaagagatcagtattatcgtgttaatggacatatcgttattgttacagcagtagatgattttgaggttcactatactttacttaaatggaataaacgcttgatttgcgatcgtgctgcatttagttcagttgctaaggaaattaaactccatgggtaaaacgtatcgtcgtaaagacttgaaagttcgtgattatgactatttcggaaagcgtaaagctcctgatggtgtaagtcataaagatatggttgaaaacatttttcgctcagataaatggcgtagaatgaaaggtattgattcagaagttaaagatgagttaaatcgtcaattacgcggtgaagtaagaaagttgaaaaaatcagtttacattgacgatgattttgattataatacttctcaacgagttgctaaacgtaaatcaaacgagtgttatcgttatagctgaggaaaatatgaatatcaaacgaatgctttttaagcaggggttatatactttaaatgttactccaaaaggcgatacaactaagtggtcagtaaatgactggattaaatttattgatgaaaatggcaattgggaaatttaaatgaatcctgaatctaaattatcgcagcgaattgctgaagaacgcgccaaatttttccagaacatgaaacacaatggtattgaggatgaagtttttctaaattggttctggaataataagtacacagcatgtgaaggagctttgtcattgtcagtcgcaatgatgtacgaaggctggaagggtgccaaaaagtttagctaagggcttcggcccttttttggataataaaattttaacgtaattgaggataatgtatgactattcaaattaaaaacgccatcaattcttacgcatatgataaagtagtttctttgctagaaaaaggcgatattgtaactcctcaaattttggataaatgggaaaaagagcttcatcagacgatgaaacagaatgatcagaagattggacgcaatactgtccgtgaattgttggttcaatatatcttgtcagaatttgatgttaaagcttttggtgtagaatctaaagcttatcaaaagcatgaaatttccgataaaactattcgtcgcatgaaaaatcaacgcaagaaaaaatttgctgacctgaaaattactaaggcataattatgaatgaagctcttattaacgatttacgtcttgctgggtatgaagtaaatacaaacggcagtggtttaactcaaattgaaggaaatggattcattcttgagtatgaatttagccaatggtggttatatgccaattacggcgaattgattgaatatgttgaccaatttgattcactagatgcagctcttgaagcggctaagttgatgaatgtatgaaatttattaatatttctattactattgaaaattatggcattttctatgttgaccaatacatgaaaatttcatttttcccaaataagactggtgttggatattgggaaagccatgtttctgaattaaatgaaagtgaatatgttagtacacatgaaaagtttttagactttttatatcatgctgatctaactagtcattatatagatattcatgaatttaaaaagatgatggagaaagtattccaagcatactgcttacttagataactgatatcctctatgctttaagatagatcttcaaatattatgatataatagatctatgaattgagctaagaggtgaaaatgtcagaaactaagcctaaatataattacgtaaacaataaagagcttttacaagctattattgattggaaaacagaattagcaaataataaagacccaaataaagtagttcgtcagaatgatactatcggattagccattatgcttattgcagaaggcttatctaaacgtttcaacttttcaggatacacccagtcttggaaacaagaaatgattgcagatggtatagaagcttctattaaggggcttcacaattttgatgaaacgaaatataaaaacccgcatgcatatataactcaagcttgttttaatgcattcgtccaacgtattaaaaaagaacgtaaggaagttgcaaagaaatacagttacttcgttcacaatgtctatgacagtcgtgacgacgatatggttgcgttagtagatgaaacttttattcaagacatctacgataaaatgacgcattacgaagaatcaacctatagaacaccgggggctgaaaagaaaagtgttgtagacgattctcctagtttggattttttatatgaggctaacgattaacctctccggattcttggaagaaatacctgaagttgaagctattccctatttacttaaaatgtatctcagggaagttttagctcttgacattgatattgatccagaaaatccgtatgataccgcttttaaatctaatggtgtagaattaaactatcggtatcatttaacagatgatgatttttattttatattagagaaataatatgactgataaacccgaaattaatgatgaagtgaaaaagcttatttcttctattgaagaaaagaaccgtcttgaagcagaaagaaaagcaaataagttattgtctaaaaataaacgcgaactgaatcgtctttataagcacgctcagatcgcagctgaaaataataattttgctcaatacgaatatgctatcaagaaaagtcgggatattctaaaacagccatataacgatgaactcatcagtattctttggaagactactagatcgcagattgaggatatgattgatgcttacacacgtaaaattcaagcgtcttaaaattaatgcaggatttactgaatctttgaatggtcatctttgtgtgaaaatttctgaaaaagaataccatgatagttcaattaaagaagttaatcctcctattgtaagagcagaccctaatatgaaagtgtgggttgattcttatcaagtcaaaaaatggtggcagttatgaaagatgaacacccagacttctgaaatagattataataaaattcgttcctctaaagtagaaatgatgagacgctttaaagagtcttacgataaagctaaagcagaaggaactataacatataggcgcagaaaatttagaagctctaatgagcctttgtatggcgtattatgtggataggagcttcggctcctatattgctttataaatttttggtaaaataaaccaaaacaaagaggatattaaatgaaagtatgtatttttatggctcgaggtcttgaaggttgtggtgtaacaaaattctcactcgagcaacgtgattggtttattaagaatggtcatgaagtaactttggtttatgctaaagataaatcatttactcgtacaagttctcatgaccacaaatcattttcaattccagttattttagctaaagaatacgataaagcacttaagctggtaaatgattgtgatattctaattattaattctgttcctgctacttccgttcaagaagccacgattaataactataaaaaacttttagataatattaaaccttctattcgtgttgtagtttatcagcatgatcattctgttctttctttgcgtcgaaatttgggattagaagaaactgttcgtcgagctgatgttatttttagtcattctgataatggcgattttaataaagttctgatgaaagaatggtatccagaaactgtttctctgtttgatgatattgaagaagcaccaacagtatataattttcagcctcctatggatattgcgaaagttcgatcaacctactggaaagatgtttctgaaattaacatgaatatcaatcgttggattggtcgtacgactacatggaaaggtttttaccagatgtttgattttcacgaaaaattcttaaaacctgctggtaaatccactgtaatggaaggtcttgaacgttcccctgcttttattgcaattaaggaaaaaggtattccgtatgaatattacggtaatcgtgagatcgataaaatgaatctcacgccgaatcaaccggcacaaatcctagattgttatattaatagtgaaatgcttgaacgaatgagtaaatctggctttggatatcagttgagtaaacttaaccagaaatacttacaacgctcactagaatatactcatcttgaattaggtgcttgcggtacaattcctgttttctggaaatctactggcgaaaatttaaaattccgtgttgataatactcctttgacctcgcatgatagcggtatcatttggtttgatgaaaatgacatggaatcaacattcgagcgtattaaagaactgtcatctgaccgagctctttatgaccgtgagcgagaaaaagcatatgaatttttgtatcagcatcaagattcaagcttctgctttaaagaacagtttgacattattacaaaataaagggcttcggccctttagctttatacggagtttgatataatgatatttcttggatatgtgatactttttctcgcgttttatctattcactagagcatgttggattgggttctttagcactccagatggatttatttcaataattttattttgcatttcaatgacggttcttgatatatgaaaattttaaatttaggtgattggcatttaggtgttaaagctgatgatgaatggattcgcggtattcaaattgatggaattaagcaagcgatagaatattctaagaaaaatggaattactgtatggattcaatacggtgatatttttgatgtacgaaaagcgatcacgcataaaactatggagtttgcccgtgaaatagttcaaatgcttgatgacgctggaatcacattacatactattgtaggaaatcacgatctccactacaaaaatgtaatgcatccaaatgcctctactgagcttttggctaaatatcctaatgttaaagtatatgataagcctactacagtagattttgacggatgtttaattgatttaattccttggatgtgtgaagaaaatactggtgaaattcttgagcacatcaaaacttcatctgcttctttttgtgttggtcactgggaactgaatggattttatttttataaaggaatgaaatctcatggtcttgaacctgatttccttaagacttataaagaagtgtggtctggtcacttccatactatctctgaggctgctaacgtcagatatattgggacaccatggacactaactgcaggtgacgagaatgaccctcgcgggttctggatgtttgatacagaaacagaacgaatggaatttattccaaacaatactacctggcatcgtagaattcattatccatttaaaggaaaaattgactataaagattttacaaatctatcagtacgtgttatagtaactgaagtagacaaaaatctaacgaagttcgaatctgaactagaaaaagttgtgcattcattacgagttgtgtcaaagattgataactctgtcgagtcagatgacagtgaagaagttgaagtccaatcgcttcagacattaatggaagagtatattaatgcaattccagacatcactgattctgaccgtgaagcacttattcaatatgcaaatcagctatatgtagaggcaacacaatgacttttgatgaatttaaaaatgttatgatgagtcagcattttgaatgcgaagtaaaagatgatattgggcataaagaaattattgaatattggtttgaaccgttagaggttgaagataattgtattaaaaaggttacagtctgcactgactgggctgtatcttttaacttcaacattttagataatgacacacctaaatcattacgagatatggccgtatcttgtattaaggatgcatactgtgaagttttcgacatttgacattaatgatgaattcatagcaaacattgattataccgaagaagattctagatatgttggaataatttatattacatcgaaaacagcacaaggcgttgtttgcatggctgaatttgatgaatactttttagattatgatgatatgatagaatggtctaaaagatacattaaaaggaatcttttgtgaagaattttaaactaaaccgagttaggtatcaaaatataatgtcagtaggtggaaatcctattgacattcaactagataaggttcaaaaaactcttattactggacgaaatggcggtggtaagtctactatgttagaagccatcacatttgggctttttggcaagccatttcgtgatgtaaagaaaggtcaattaataaacagcacaaataagaaagaacttttagttgaactgtggatggaatatgatgagaaaaagtactatatcaaaagaggacaaaaaccaaacgttttcgaaatcaccgttaacggtacacgtcttaatgaatctgccagcagtaaagatttccaagcagaatttgaacagcttatcggaatgtcatatgccagtttcaagcagattgttgtccttggtacagcagggtatacccctttcatgggtttgtcgacccctgcgcgaagaaagcttgtggaagacctgcttgaggtaggaacattagctgaaatggataagcttaataaagcactaatacgtgaattaaattcacaaaaccaagtgcttgatgttaaaaaagatagtattatccaacaaattaaaatatataatgataacgttgaacgccagaaaaaattaacgggtgacaaccttactcgtctacaaaatatgtatgatgatttggcaaaagaagctagaacgctaaaatcggaaatagaagaagctaatgaaagattagttaatattgttttagatgaagacccgactgatgcatttaataaaatcggtcaagaagcagttttaattaaatcaaaaattgactcgtataataaagtcattaatatgtatcacgaaggtggattatgtccaacctgtttgtcacaattaagttccggtgataaagttgtttctaaaattaaagataaagtttctgaatgtacgcattcgtttgaacagctttcaacgcaccgtgataatttaaaagttcttgttgatgaataccgagataatattaaaacccagcagtcgttggcaaatgatattcgcaataaaaagcaatctctaatcacgacagtagataaagctaaaaaagttaaagcagctatagaaaaagcatcatccgagtttattgaccatgctgatgaaatagcactgcttcaagaagaacttgataaaattgttaagacaaaaactaatttagtaatggaaaaataccaccgaggaattttgactgatatgctcaaagattctggtattaaaggtgctattattaaaaagtacattccattatttaataagcagattaaccattatcttaaaataatggaagcggattatgtgtttacattagatgaagaatttaatgagacaattaaatcccgtggtcgtgaagattttagttatgcttcatttagtgaaggtgaaaaggcacgaattgatattgctcttttatttacttggcgtgatattgcttctatcgtatctggtgttagtattagtacattaattcttgatgaagtgtttgatgggtcatttgatgccgaaggtattaaaggtgtagctaatattataaattcaatgaaaaacactaatgtttttataatttcgcataaagaccatgacccgcaagaatatggtcagcatcttcaaatgaagaaagttggtcgatttactgtaatggtttaatttataagagattatgctttaatttattagagtataatctctatggaggaaaaacatggaatattcaactggacagcatttattaacttttcctgaaataaaacgatatattctgagaaataatttttctaatgaagagcatatagttactgaatctatgcttaggaatgcatttaaagcagaatatacaaaaataatgtccaatagaaatgaagcttggactgttactgattattatgactaaaggtgtattatgactaaaattactgtgaattatactgttgatgtaaaagatattcagccaaaacacgtgcgttctgaatcaaatccacaaaaccaaaataaaattcgtcgagcatgggttttgtctctttctgataacgcaatggaagttattcagaacaaaattaaatctgcacctgctcgtcatgcgtattatgaagctatcgatcgtgaagtaagtaataaatggattgaactaatgcgcaaacatactacagaatccctaaacgccggtgctaaatttattatgacttcatgtggtgaacgccttgaagatgattattgtggtaatgcagatgaacgtctgattgttgctgcacaaattgttgccgaaacaatcgcaactgattttaatcgttaattgctttattaaattagttataaaattaaatctcatttgaattgaaggaaattacatgaaactgtctaaagatacactgaatattttgaaaaatttcgctactattaactctggcattatgcttaaatccggtcaatttattatgactcgcgcagttaatggtacaacttacgcggaagcaaatatttctgacgttattgattttgatgtagcaatttacgatttgaacggttttctcggtattctgtcgctagttaatgatgatgcagaaatttcccagtcagaagatggaaatattaaaattgctgatgctcgttcaacaattttttggccagcagccgatccgagtacagtagttgctcctaataaaccaattccatttccggtagcatctgttgttactgaaattaaagctgaagaccttcaacaactgttgcgtgtatctcgtggtctgcaaattgatacaattgctatcacggtaaaagaaggtaaaatcgtaattaacggttttaataaagtagaagattctgctctgacccgtgttaaatattctttgactcttggtgattatgatggtgaaaatacatttaatttcattatcaatatggcaaatatgaaaatgcaaccaggaaattataaacttctgctctgggcaaaaggtaaacaaggtgctgctaaatttgaaggtgaacacgcgaattatgtggtagctcttgaagctgattctacccacgatttttaataaagggcttcggccctttataatttacactaaaacttgaatgaggaaattatgattaccgtaaatgaaaaagaacacattcttgaacagaaatatcgtccatctactatcgatgaatgtattcttcccgcctttgataaagaaacctttaaatctattacaagtaaaggtaagattccacatattattcttcattctccttctccaggaacaggtaaaacaactgtagcaaaagcattgtgtcatgatgtaaatgctgatatgatgtttgtgaatggatcagattgtaaaattgatttcgttcgcggtcctttgactaattttgccagcgccgcttcatttgatggtcgtcaaaaagtaatcgttattgatgaatttgaccgctcaggattagcagagtctcagcgacatcttcgttcctttatggaagcttatagttcaaactgtagtattattattactgctaacaatattgatggtattattaaaccacttcagtcacgctgccgagttattacgttcggtcaaccgaccgatgaagataaaattgaaatgatgaagcagatgattcgtcgattgactgaaatctgtaagcatgaaggaattgctatagctgatatgaaagttgtagcagctttggttaaaaagaattttcctgattttcgtaaaactattggcgagctcgatagttattcatctaaaggtgttttggatgctggtattttatcactggttactaacgatcgtggtgctattgatgatgttcttgagtctctcaaaaataaagatgttaaacaactcagagctttagcaccaaaatatgcagctgattattcgtggttcgtaggtaaacttgccgaagaaatctattcacgtgtaactccgcagagtattattcgtatgtacgaaattgtcggcgaaaataatcagtatcatggtattgcagctaatactgaattgcatttagcttatcttttcattcagttagcatgtgaaatgcagtggaagtgatatgagcttatttgaagatgatattcaattaaacgagcatcaagttgcttggtattcaaaagattggacagctgtccaatccgctgctgattcttttaaagaaaaagctgaaaatgagttttttgaaataattggagctattaataataaaactaaatgctctattgctcaaaaagattattcaaaatacatggttgagaatgcattatcacaatttccagagtgcatgccagctgtatatgctatgaatttaatcggttctggattaagtgatgaagctcattttaattatctgatggctgctgttcctcggggtaaaagatatggtaaatgggcaaaactggttgaagattccaccgaagtattgattattaagttacttgctaagcggtatcaagttaatacaaatgatgcaattaactataaatcaattcttactaaaaatggaaaactatctttagtattaaaagaactaaaaggtttagtcacggatgattttttgaaagaagtgactaagaacgtaaaagaacagaaacaactcaaaaaactagcattggaatggtaaaatgattgaaattactcttaaaaaacctgaagattttctgaaagtaaaagaaactttgactcgtatgggaattgctaataataaagataaagttctgtatcagtcctgtcatattcttcagaaaaaaggactatactatatcgttcattttaaagaaatgcttcgtatggatggtcgccaagttgaaatgacagaagaagatgaagttcgtcgtgattcgattgcatggctgttagaagattggggactgattgaaatcgttcctggtcaaagaacttttatgaaagatttaactaataatttccgagttatttcttttaaacaaaaacatgaatggaaactcgttcctaaatatacgattggtaattaatatgactgctataactccgcaagaatacatggcgtctcttaaagaaaaatataatctttctgcaacagaaacacttttcgatttaccagaaaaccttcaactaaaatttcaggtagaatttcaaaaattaattcacccagaacaaaaacactttactgcagtcgttaagtcaattaatgcagatggaatgacaatttttcaccgacaaatagtactaatttaagcaaggggcttcggccccttatttggagtataatatatcaagagcctaataactcgggctataaactaaggaatatctatgaaagaattttatatctctattgaaacagtcggaaataacattgttgaacgttatattgatgaaaacggaaaggaacgtactcgtgaagtagaatatcttccgactatgtttaggcattgtaaggaagagtcaaaatacaaagacatctatggtaaaaactgcgctcctcaaaaatttccatcaatgaaagatgctcgagattggatgaaacgaatggaagacatcggtctcgaagctctcggtatgaacgattttaaactcgcttatatcagtgatacatatggttcagaaattgtttatgaccgaaaatttgttcgtgtagctaactgtgacattgaggttactggtgataaatttcctgacccaatgaaagcagaatatgaaattgatgctattactcattatgattcaattgatgatcgtttttatgttttcgaccttttgaattcaatgtacggttcagtatcaaaatgggatgcaaagttagctgctaagcttgactgtgaaggtggtgatgaagttcctcaagaaattcttgaccgagtaatttatatgccattcgataatgagcgtgatatgctcatggaatatatcaatctctgggaacagaaacgacctgctatttttactggttggaatattgagggatttgacgttccgtatatcatgaatcgtgttaaaatggttctcggtgaacgtagtatgaaacgcttctctccaatcggtcgagtaaaatctaaactaattcaaaatatgtacggtagcaaagaaatttattctattgatggcgtatctattcttgattatttagatttgtacaagaaattcgcttttactaatttgccgtcattctctttggaatcagttgctcaacatgaaaccaaaaaaggtaaattaccgtatgatggtcctattaataaacttcgtgagactaatcatcaacgatacattagttataacatcattgacgtagaatcagttcaagcaattgataaaattcgcgggtttatcgatctagttttaagtatgtcttattatgctaaaatgcctttttctggtgtaatgagtcctattaaaacttgggatgctattatttttaactcattgaaaggtgaacataaggttattcctcaacaaggttcgcatgttaaacagagttttccgggtgcatttgtgtttgaacctaaaccaattgctcgtcgatatattatgagttttgacttgacgtctctgtatccgagcattattcgtcaggttaacattagtcctgagactattcgtggacaatttaaagttcatccaattcatgaatatatcgcaggaacagctcctaagccaagtgaagaatattcttgttctccgaatggatggatgtatgataagcatcaagaaggtatcattccaaaggaaatcgctaaagtatttttccagcgtaaagactggaaaaagaaaatgttcgctgaagaaatgaatgccgaagctattaaaaagattattatgaaaggcgcagggtcttgttcaactaaaccagaagttgaacgatatgttaagttcagtgatgatttcttaaatgaactgtcgaattatactgaatctgttctcaatagtttgattgaagaatgtgaaaaagctgctacacttgctaacacaaatcagctgaaccgtaaaattctcattaacagtctttatggtgctcttggtaatattcatttccgttactatgatttgcgaaatgctactgctatcacaatttttggccaagttggtattcagtggattgctcgtaaaattaatgaatatctgaataaagtatgcggaactaatggcgaagatttcattgcagcaggtgatactgattcggtatatgtttgtgtagataaagttattgaaaaagttggtcttgaccgattcaaagagcagaacgatttggttgaatttatgaatcagttcggtaagaaaaagatggaacctatgattgatgttgcatatcgtgagttatgtgattatatgaataaccgcgagcatctgatgcatatggaccgtgaagctatttcttgccctccacttggttcaaagggtattggtggattttggaaagcgaaaaagcgttatgctctgaacgtttatgatatggaagataaacgatttgctgaaccgcatctaaaaatcatgggtatggaaactcagcagagttcaacaccaaaagcagtacaagaagctctcgaagaaagtattcgtcgtattcttcaggaaggtgaagagtctgtccaagaatattacaagaacttcgagaaagaatatcgtcaactcgactataaagttattgctgaagtaaaaactgcgaacgatatagcgaaatatgatgataaaggttggccaggatttaaatgtccgttccatattcgtggtgtgctaacttatcgtcgagctgttagcggtttaggtgtagctccaattttggatggaaataaagtaatggttcttccattgcgtgaaggaaatccatttggtgacaaatgcattgcttggccgtcgggtacagaacttccaaaagaaattcgttctgacgtactgtcttggattgactactcaactttgttccaaaaatcgtttgttaaaccgcttgcgggcatgtgtgaatcggctggtatggactatgaagaaaaagcttcgttagacttcctgtttggctgatagaataaatctagggacctccgggtccctttttcatacaagtaatataaatctatacttatgaaaaacagatgattctggacatttagaattccctaaaaaattttcacaaaactgtttacatctctgttcttccatggtactatacaactatcaactactgatacggatttggagaataaaatgaaaattgttatgggttgcttagcagtttgtttagttgcattagcagcagttccatttgttagtgttgaaaatgatactcaacctgtgattgaatctagcactgttattcacactaatggtaaaatatcagttaaaattgatgataatcttcatgtgaatacaaatggatctttaggtgtgcaaatgggtaatacctgcataagcactactggagtaattactacttgtatttgaggaaattattatgaaaatcgctattttggttattgcattaggtcttactggttgtgtagctcaaggaccggtagtaaatcagtctgatgtaggaaaaattgtaaactgttcaagcaaattttataatcctaatgtcaagtgttataaagaagctccaaaacagacagtagaacaaatgcaggcgaattttgacgaggctattcgtccagatgaatctgctcaagcatatcgtaattcggatgtaattacacgcgaagaaaaaattgaaaactactgcgccgagctttgggctaattgggccaataattaccaatggcgtactggtaaaaatgctccgatggagtatgtagtgaattcttataattcatgtgtaaaaaatttgactaagtgaggaaaatatggaaactttagtaacaggttcaatttttatggttttagtttcaggtgtgttggctattattatatacatgcttccatggtttatcgccttgatgcgtgggtcaaaatcgacagtaggaatctttttcacatctttactgtttaactggtcaattattggttggtttattacatttatttggtcaattgcgggtgaaactaaaaagtctgcacagccaaatcaagtaattatcatcagagagaaggaatgaaaagcaaaattatagcagtgttgcttttaatcttgatgattataataagtatatactatagtgtaacggttcctcttatgattccaactattattttaggttggagtttattactgttacaagttaaatatgaatgtatcaattgaggtttaaatgattagtgactctatgacagttgaagaaatccgtcttcatttggggcttgcattaaaagaaaaagatttcgtagttgataaaactggtgttaaaactattgaaattattggcgcatcatttgtagcagatgaaccgtttatttttggcgctcttaatgatgaatacattcagcgtgaacttgaatggtataaatctaagagtttgtttgttaaagatattccaggtgaaacaccaaagatttggcagcaggtagcatcttctaaaggcgaaattaactcgaattatggttgggctatttggtcagaagataactatgcccagtatgatatgtgtttagctgaacttggtcaaaatcctgattctcgacgtggtatcatgatttatactcgtccatctatgcagtttgactacaataaagatggtatgtcagatttcatgtgtactaatacagtacagtacttgattcgtgataagaaagtcaatgcggtagtaagcatgcgctcaaatgacgtggtcttcggattccgtaatgattatgcatggcaaaaatacgtattagataaattagtatctgatttgaatgcaggcgattcaactcgtcagtataaagcaggttctattatatggaatgttggaagtcttcatgtatattctcgtcatttttatttggttgatcattggtggaatactggcgaaactcatattgtgaaaaaagactataaaggtgagtggaaatgattcaattcgtaattccaagttatcaacgtgtcggggcagtttctgcccttaatatgtttccgactgattatgaaccccatattgtggtgcgtgaacacgaagaaaaagcttattatgatgcttatgggtctagagctaaaattgtaactattcctgatgatgttaatggaattgccggtactcgtaaagcaattactgatatgtatgcaggtcaacgaatctggatgattgatgatgatactactattcgtatgagttcaatacgaaagagagacgataaacggcgtgtagataaaattaatcaattaactcgtgaacagttctatgaattaattcaatacgttgaagatgccatggattgcgggtattatcacggtcatgctcgtctaccaatttttaaaattacttcatcttggggcaattatcgtgaaaactcatatggattcacgaatacatggtatgacctcggaaaacttacgacagaacaaattgggtatggaaaaattgatttatgcgaagatatgtatgcatttctcaatttaattaatcaaggttatccgcatttggccttgttcaaatatctagttgtatctggaaaatcacacgctcccggtgggtgtagttcaattcgtagtaattctaaacataatagagcgcttgagcaaatcaatagagagtttccagagcaagctcgttggaaaacatcgaatattgaaaaacgaaaatcgttgggtgaagaagacgagccattaaaggttcttcgcatgtgtgtttcgcgtaaagaaaaatcagaagcatttcataagtttaatgctattcatccaatagcagttgattaatgcctaaatttattgtgttataattactatatctttaaccagtgaggaaaatataatgatgcctatggaaaaaatgaatgtctattgcagatttaaaatcccgtttgattaaagcttccacttctaaaatgactgctgaactgactacatctaaattctttaatgaaaaggatgtaattcgtacaaaaattccaatgcttaatatcgctatttctggtgcgattgatggcggtatgcagtctggtttaactatttttgcagggccttctaaacactttaaatcaaatatgtctttgactatggttgcggcatatttgaacaaatatcctgacgcggtttgtctattctatgatagcgaatttggtattactccagcttatttgcgatccatgggagttgacccggaacgtgtaattcatacgccaattcaatcagttgaacagctgaaaattgatatggtgaatcagcttgaagctattgagcgtggtgaaaaagttattgtattcatcgattcaattggtaatatggcttctaagaaagaaactgaagatgccttgaatgaaaaatctgtggcagatatgactcgtgctaaatcactgaagtcattattccgtatcgttactccttattttagcattaaaaatattccatgcgttgcggttaaccatacaattgaaacaattgaaatgtttagtaaaaccgtgatgacaggtggtacaggcgtaatgtattcggctgataccgtattcattatcggtaagcgtcagattaaagatggttctgatcttcaggggtatcaatttgttctaaatgtagaaaaatctcgtaccgttaaagaaaaaagtaaattctttattgatgttaaatttgacggtggtatcgatccttattctggattgttagatatggctctagaattaggatttgtagtaaaacctaagaatggttggtatgctcgtgaatttcttgacgaagaaaccggcgagatgattcgcgaagaaaaatcttggcgtgcaaaagatactaactgcactacattctggggtcctttatttaagcatcaaccattccgagatgctattaaacgtgcttatcagttaggtgctattgatagtaatgaaattgttgaagctgaagttgatgaattgattaactcaaaggttgaaaaatttaaatctccagaaagtaaaagtaaatcagctgctgatttagaaactgacctcgaacagttaagtgatatggaagaatttaatgaataaagatgatttagacttagatctagaaattatcgatgaatccccctcttcggagggggaagaagaaagaaaagaacgtctttttaatgagtctcttaagataattaaatccgctatggaaaatgttatccaggagattgtcattaaactagaagatggttctacacacattgtgtatgtgacaaaattagattgggttgatggaaaagtcgtaatggactttgctgttcttgaccaagaaagaaaagctgagttagctcctcatgtagaaaaatgtattacaatgcaactacaagatgcatttaataaaaggtcaaagaaaaagtttaaattcttttaaggagtaagtgtggtagaaattattctttctcatctcatatttgatcaagcttatttttcaaaagtttggccatatatggattcagaatattttgaaagtggtccagctaaaaatacattcaaattaattaaatctcatgtcaatgagtatcatagcgttccatctattaatgcgttaaatgttgcattagaaaatagttcatttactgaaacagaatattctggtgtaaaaacacttatttcaaaactggctgattctccggaagaccacagctggttagtaaaagaaacagaaaaatatgttcagcaaagggcgatgtttaatgctacgtctaaaataatcgaaattcaaactaatgctgagcttcctccggaaaaacgaaataagaaaatgccagatgtaggtgctattcctgacatcatgcgccaagcattatcaatttcatttgatagctacgttggtcatgattggatggatgactatgaagcgcgttggctatcttatatgaataaagctcgtaaggttccatttaaactcagaattctaaacaaaattactaaaggcggagctgaaactggaacactgaacgttttaatggctggtgttaacgttggtaagtcattaggactttgttcattagcagcagattatttgcagcttggtcataacgttctttatatctccatggaaatggcagaagaagtctgtgctaaacgtattgatgctaatatgcttgatgtttctcttgatgacattgatgacgggcatatttcttacgctgagtataaaggaaaaatggaaaaatggcgcgagaaatctactctcggtcgtttaatcgttaaacagtatcctactggtggagcagacgctaatacatttcgatcacttttaaacgaattgaagctcaagaagaattttgttccaacaatcattattgtcgactatctaggtatttgtaaatcttgtcgcatccgagtttattcagaaaatagttacacaactgttaaagctattgcagaggaattgcgtgctctggctgttgaaaccgaaactgttctttggactgcagcacaggttggtaaacaagcttgggattcttctgatgttaacatgagtgatatcgcagaatctgccggtcttccagcaacagctgattttatgcttgcggtcattgaaaccgaggagttagcagctgctgaacaacaacttattaagcaaatcaaatcacgatatggtgataagaataaatggaataagtttttgatgggtgttcaaaaaggaaatcagaaatgggtagaaattgaacaagattctactccaactgaagtgagtgaggtagcaggttcacaacagatacaagctgagcagaatcgctatcaaagaaacgaatcgactcgagctcagttagatgctttggcaaatgaattaaaattttagtttacaagctgacaagactatggtatagtagtcttgttggttaaatgaggagattgttatggaattggtaaaggtagtttttatggggtggtttaagaatgaaagcatgtttactaaagagatcacaatgatgaaagatgacgttcaatgggctactactcaatatgctgaagttaataaagcactagttaaagctttcattgatgacaagaaggtatgtgaagtggattgccgaggataatatgcatatcgttttatttaaacctactccgtataatgtcaggaaaaatactcaattcaaagcacttattgcagatacgtgggaattagtattagatattccggcagaagaaagccctccatttggtcgagtggaatttattaagtttgctgtgcgccctacaaagcgacagattcgtcaatgcaaaagatactttcgtaaaatcgccaagttagagaaacagtttgtaacatgtgattacgcaaaagttttaaaataactgtttacttttattggaaattgagatactatataaacataaactactgaggagattatcatgaaaaaatttatctttgctgcaatttttgctttatcttcttgcgctgctcagcctgctatggcgggttatgacaaagatttgtgcgaatggtctatgactgcggatcagactgaagttgaaactcaaattgaagcagatattatgaatatcgttgaacgtgatcgtcctgaaatgaaagctgaagtgcaaaaacagcttaagtctggtggtgtaatgcagtataattatgttctgtattgcgataaaaactttaataataaaaatatcatcgctgaagtggtaggtgaataatgctttatcaaatgcacaagtgtaaagacacgtacaaatataaaggtgcccagtgttatatcattaatcgtgaaaacgcaggtccaggccattcgcatcaatcacggtttgtattcgttaaaaataatgaaattatagcagttgctaattatatgcttgtgaccaatgatgttaatccggtgcctttcacatatgacaatctaatggacttggcatatgattataattggtttaatcatgacaatttagttcatattgaaggcgtaggatttgacatctcttattctagttattcgttgtgccctatgagccgagctcataaagagcctgaatatttttcatttcgtcggcgtgtagactttaaacgcagtacagagtatgtcggtggaatctttgttaaagataatcgaattactcgcattatttatcctttgggctttggtcaaaaagatattgatgttgatttagactttactgaaagcagcattaatcatattgcttctgtgtattttgatattgatcacaaaattgtaatatgtggatatgaattaccatccgaaaaacagtctaaagtaaatgtttctattgatgaccaaatttttaatgcttttatgaatagaggttaatatgaaaacatttaaagaatttattaaagaagatatggtcgctggagattcaggtggtaatcctgaaaatatctctactggaacaacatcaggcgctgtagtaaataaaggtcctgaacagattcctaaaaagaaaaaagaggaatctaaagaaaaagaagagtaaaaatgtcatcaataccttggattgataatgagtttgcgtatcgtgcattagctcatttacctaaattcacacaagtaaataatagttcaacttttaaattacggtttagatgcccagtgtgtggagattcaaaaaccgaccaaaataaagcccgtggatggtattatggtgataataatgaaggaaatattcattgttataactgtaactatcatgcaccaatcggaatatatttaaaggagtttgaacctgatttatatcgtgagtatatctttgaaataagaaaagaaaaaggtaaaagtcgtccagtagaaaaacctaaagaacttcctaaacaacctgagaagaaaataattaaatctcttccgtcatgcgttagattagataaactggcggaagaccatccaattataaaatatgtaaaagctcgttgtattccaaatgataaatggaaatatctttggtttacaaccgaatggcctaaattagttaatagcatagcaccaggaacatacaaaaaggaaatttctgagcctcgtcttgttattccaatttataatgctaatggaaaagctgagtcttttcaaggacgtgcattaaagaaagatgctcctcaaaaatatatcaccattaaagcttatcctgaggcaacaaaaatatatggagtcgaacgagttaaagatggtgatgtatatgttctagaaggacctatagattcactttttattgaaaatggtatagctattacgggtggtcaattagacctagaagttgttccatttaaagatagacgagtgtgggttttagataatgaacctcgtcaccctgacactatcaaacgaatgactaaattagttgatgcaggagaaagagttatgttttgggataaatctccctggaaatcaaaagatgttaatgatatgattagaaaggaaggtgcaacccctgaacaaattatggaatatatgaaaaataatattgcccaagggttgatggctaaaatgcggttatctaaatatgccaagatttaaattaacccaactaaagcaaatgctagatctacgaatgtatcaagagtaattactggaatattaacaccatgagcaatagcaattggtgataaaacaaaattccagagtaaaattcctaccatagcagaaatagtaaaagctatacgttttttattaccttttatggcattaacaagtgccattaatttttgtgccatatgtcctcctttaaattaatatttatcacaaatttcataaatttgtttactttctcagcttgttatggtattataaaataaattgctgaggatgatataatgattaataaaattgtgcatgaaatggctttaaacggagattcatataaaatatctgccgtagttgaaaatttcatacttaataaagtaaaagaatatttcactgattgttcagttagttatcaagaaaaaatggttttaaccgatgatactgaaaaatcaaataatttgttttgttctaattttataactaagaagcgtactagaagatttgatattgttatttctcgcaacggtaaaaagcatataattgaaattaaacaccaagttggtggagatacagctattgattcggttggaatatatttagaagataaagagaaattaaaagaatacacaaaaactgaaaaccctgtgtcattgatgatattagattttttgccatgcggatattatccacgtaataaatggacaaaaagagaatcatttactgataatccaaccatccaagcaagatttaatgaatatgctaaatcacaaaacgtgttagtattactatcaaatacatatgatgaagaattatataattcgttttttgctgcaataaatgagagaatataatgctaggagctatcgcgtatacaggtaataaacagtcattattacctgaacttaagcctcattttccaaaatatgacagattcgtggatttattttgtggaggtttatcagtgtctttgaacgtcaatggtcctgtattggccaatgatattcaagaaccaattattgaaatgtataagcgtcttattaatgtatcatgggatgacgttttaaaagtaataaagcaatacaaactatcaaaaacatcaaaagaagagtttttgaaattacgtgaagattataataaaactagagatcctcttttactttatgttcttcattttcacggatttagtaatatgattcgtataaacgataaaggaaattttactactccgtttggaaaaagaactataaacaaaaatagtgaaaaacgctttaatcactttaagcaaaattgtgataaaataatctttagttcattgcattttaaagatgtcaaaattctagacggcgattttgtatatgtggaccctccatatcttataacagttgctgattataataaattttggtcagaagaagaagaaaaagaccttttaaatcttttagattctttaaatgacagaggaataaaatttggactgtcgaatgttttagagcatcacggaaaggaaaacactcttcttaaagaatggtctaaaaaatataatgttaagcatcttaataaaaaatacgtctttaacatatatcattccaaagaaaagaatggaactgatgaagtatatatttttaattaattgcttacatactcaaatgatataattatttaacttattaatgaattgaaaggaaaaataatggcttactttaacgaatgtagtcaactgatcgaaggcgctgataaagctcaaaatgaatactgggatattctcggtgatgaaaaagacccgctgcaagttatgcttgatatgcagaaatctttgcaggttcgtttagctaaagataaacctgaatataaccgtcatcctgatgatttggctactgcaggcgaagttgtcgattggctgcgtaatcagaaagattacattgatgatgaattccgcgaactattgacttctcttggtggtatgagcaatggtgaaaaagatgcatctgctgtatggaagccttggaagtcgcagcatggtgaacgtcgtgaaactctaattactgatttgtcaccacaagaccaattggaaattaaattcgaaatgattgatattcttcatttcgttctgaacatgttccaaggtctcggtcttacggctgaagaaatctttaaactttattatctgaaaaatgctgaaaacttcgctcgtcaagaccgaggttattaatggctcgtttaaataaacgccagcttaagaaagcccacaagaaacgtattgaccagctatttaaaaattatgacaaggagctcacatacgagctcctatctaatcagctccacaaagcttacacaattaaaactggacatatacaattaggtaaggtgcatgaagaagccttaaaattaattatagagcattcaaaatgaaatttgatttttatgcatggcaaaaagccgggagaccggctttttgagcatttggttctgatggatataatattagagctcattggaagtttaatgctccagccgattattctccggtaattattaacggtgatgttgttatattaactaaaattgggtattttaacgttccgcaagaatttattataaatagtcatgtaatttaaataaaggagaattacatgactagtactcgcggttatgttaatattaaaacatttgagcaaaaattagatggaaataagaaaattgaaggaaaggaaatttctgtagctttccctctttattctgacgttcacaaaatttctggcgctcattatcagatattcccttcagaaaaagcagcatattctacagtatatgaagaaaatcaacgtactgaatggattactgcaaacgaagatttgtggaaagtaactggtgaataaattcaaggactccttcgggagtccttttttcattttaccggtttactttccaaaatgagtatggtataataaaattatcttatagaggagagcactatgttaaatcgctggattaaaccaaatgaagacctccagaaggttcttgataaagctatctctgataaatggggtatgaaaagctgggattgtgatatcgtcacgcattcattcatgatgcatgcagatggttcagtcgagttcaatgctgaaatgcgatacactgattggggtggatttcaaagagtcgaatttcaaagaggctttttgtaatgtttatctttaattggtttaaaagtttctttacggattttttctctacaactcccggagaaggtgtagttcctatttcaaatgactaccttcctttaactgtagttgaatatgtttatatgggagatggaacagtagaagcggttactatgacttatgaagaagcccaggaatattataaaaatccttggcgttggtcaacacctacatcatctaatacgcagaatacacagtctagttctgattcatatgatactaatgttcctgttcatgtgtggacgggcgattcatgtggaagttcttgtgattctagttgttcatctacatcttgtgattgaggaaaattatggaagcgattttgtttgaaatgtatattagcagtaatagtttgtcatttgctaaagatgttccaattactgtagcagtaatgattgataagggttattgtgacccaatgtatctcgtagaaaatttcgtttcaatgccagttccagaagatgctgaaataaaacttaaaaagattggtattattgaaactgtaccaaatattccatttagagcaattgaagcatttactaaatccgaatacattaatgttagcgcagaacaatataatgataagcctttatctttttattcgtacgattcactatatagttggaaaatagataaaggaaataaatttataattgcaagtgaagatgcgttatcatactttatttcttctgtatggaatagtttacatccaaatttgctaaaaattcatgaatttgatgatgctcctactgttgttttaggtaaaacaaatgaaagttctgaagaaaatgtttgaatggttcaatagaccaaactcaatgtatattgatgatggctgggttgaacaagcaaataaagaaatgcagaacgaatcggaagaatggatgaaatcaatgattagtgctgagaaagaaaagaaattagaacgctcagcgcttaaattgatgagagacatctatggtgataaatcatgaacaaagatatgacgttagaagaggccaaggctaaagcaaatgaagcactggatttgcttcttaaaattggcagtaaaatgatggaagaaaatgagaaatatatccaggaaaacaaaattcctgacggcccattagtaggcaaaaggaaatcacatgattgaagtagcaaaacattattcaatagaatttatgtctaaagaaggtaaatcagtaaatgcacttgataaaaaatgctcattaattattcctttagcagaaaatccggatcttttaattaaagatataaaagaaagaaaatatccagaaaatgttattctaattataaagcatactgaagatattttacagaatactgattcaccgttttcttcttctgaagctttaactattaaaggctataaaagagctcatgaatatggtctttttgccctgtttgaagacgataaagttaaattagcacttaatttagcaggtcaaccttctaaaagtaaaacattcattattgaagatattaaagatataaatgcatttgttaagatggtctgggctcattttgatgttggactacgctggagaatgtccgaagaagaaagaaagattattgaagctaatcgtcattttggtttttatcgctaggaattaatatggatttatttgagatgttagaagataatcattctacgaataaccagaatgattctagtgattataagaaagagtaccgtatagtattacagaattatggaattgaagccccagatgctcttctagaagaactagcttcataccatcttgaccctccgccctgggctccctgggcaaaataattcaaaaagttgtttactttcctttctaacgatgatatgatagcttctgaagtatacgggaggctatcatgattattaatctcgcagatgttgaacagttatctataaaagctgaaagcgttgattttcaatatgatatgtataaaaaggtctgtgaaaaatttactgactttgaacagtcaattctttggcaatgtatggaagccaaaaagaatgaagctcttcataggcagttgaataaaatcgttaaaaagcatttaactaaatcgccttatcagctatatcgtggtatatcaaaatcgacaaaagaactcattaaagatttacaagtcggagaagtgttttcaacgaacagagtagattcatttactactagtttgcacacagcatgtggtttttcttatgttgagtatttcactgaaataatatttcgcttaaaaactgataaagcttttaattattctgaccatatcagcgatattatactttcttctcctaatactgaatttaagtatacatatgaagatactgatggattagattcagagcgtactgataacttaatgatgattgtgcgtgaacaagaatggatgattccaattggaaagtatagaataacttctatttcaaaagaaaaattacacgattcatttggaacatttaaagtttatgatattgaggtagttgaatgaaatattcagcaatgcaattaaaagattttaaaatcaaatcaatggatgcatctgtgcgtgcttctattcgtgaagaattactttctgaaggatttaatttatctgaaattgaacttttaattcattgtattactaataaaccagacgatcattcttggttaaatgaaatagtcaaatctcgtttggaaccaaacgataaacctctttggagaggtgttccagctgagactaagcaggtgttaaatcaaggaattgatattattacatttgataaagtcgtatcagcttcatatgataaaaatatagctctacattttgcttctggattagaatacaacacacaagttatttttgaattcaaagctcctatggtgtttaatttccaggagtatgctataaaagctttacgttgtaaagaatatagtccgagttttaagtttccggatagccatcgctatcgtaatatggaattagtttcagatgaacaagaagtaatgataccagctggaagtgtatttagaattgcggatagatacgagtataaaaagtattcaacatacactatctatactcttgattttgaaggatttaatctataatggaaggacttagattcattataccatgaaagttttaaagcatttttcataaagttgtttacaagctgaagtaaaaatgttatagtataagtagttaacccgtccgtgagaaaaatatgaaactgtctaaaaatcaaattcgtaaaattacacgtcgtctagagcatactcaggcatctgctaaaagacgttctaaagattttaacttagacttcaattacattaagaacattttagatcagaaagtttgcgcttactcaggagaaccttttgataatcgtattgaaggagagaaattatcattagaacgttttgataataacgttggatacattaaagggaatgttattgcagtaaagaaaaagtacaatacatttcgttctgattatactttagaagagttgattgaaaagcgtgatttatttgctttgcgaattggtcgttcatctgcgaaaaaagttcataaactaaatttagatgaaaagaaatgggctaaaatcaaaaagacttataatcaaattaaagctatacagaaaaaacgtgaaaaccgaattgaacacatttctcagctttctaaatcaaaacagacctctgacattaagctaaggattatagcacttaaagcacgtattgatggttctcgcatagcagaaggcgctgaagttgttaaattgaacgttcttcttaaaggctcggattggaaaattgtgaaaaagctgtcagaagcagaaatgcaatatgatatgtgtgataaaattattcaaggtgtagagcggtatcaaaatttgtcttttattgataaacttaaactgaaaagaggatacccgctaaattgttcaatttttaaacttatccgaggataatatggtttatgtatatgcgatagtttaccgagacaaagacggatttacggcgccagttccacttgatgaacatcgtcctgctgtattttttgaaagggagattgctgataaagtatttactactcttaaagagcagtatcgactagctttaggtaaaggaattccaagattagttgagactccacgtaaattttggtttaataaaatagaagttaaacatgttaagcctgatgtagatacacaaagattatatcaacgaattctagatactgggcgtattgttagtattccaattgcagggactttccgatgacatttgatgatttgacagaaggccagaaaaatgcctttaacatcgttatgagggctattaaagaaaagaaacatcatgtaactattaatggacctgctggtaccggtaagactactcttactaagttcatcattgaagctttaatatctacgggtgaaactggtattattttagcagctcctactcatgcagctaaaaagattctttcaaaactatcagggaaagaagcaagtactattcatagcattcttaaaattaacccagtaacatatgaagaaaacgttctttttgaacaaaaagaagtaccggatttagctaaatgcagagtattaatctgcgacgaagtgtcaatgtatgatagaaagctatttaaaattctgctttcaactatcccgccgtggtgtactataattggaataggtgataataagcagattagacctgttgacccaggagaaaacactgcttatatcagtccattctttacacacaaagatttttatcagtgtgaacttactgaagttaaacgcagtaatgctcctattattgatgtagctactgacgttcgtaacggtaagtggatttatgataaaattgttgacgggcatggagtacgtggatttacaggtgataccgctttacgcgattttatggtaaattatttttcaatcgtaaaatcactagatgatttgtttgaaaatcgcgtaatggcatttacgaataaatctgttgacaagttaaatagcattattcgtaaaaagatttttgaaactgataaagattttattgtcggtgaaattattgtaatgcaggaaccattaattaaaacatataaaattgatggaaagcctgtgccagaaattatttttaataacggacaattagttcgtattatagaagcagagtatacatcgacgtttgttaaagctcgtggtgttcctggagaatacttaattcgtcattgggatttaacagtagaaacttatggcgatgatgaatattatcgtgaaaagattaaaataatttcatctgatgaagaactgtataagtttaacctatttttaggtaaaacggcagaaacttataaaaattggaacaaaggcggaaaagctccatggagtgatttttgggatgctaaatcacagtttagtaaagtgaaagcacttcctgcatcaacattccataaagcacagggcatgtctgtagaccgtgctttcatttatacgccttgtattcattatgcagatgctgaattggctcaacaacttctttatgttggtgttacccgtggtcgttatgatgtgttttatgtatgattaaatttgaggaagctattcgtggaaataactaaagatcagttttatcttcttcaagataaagtaagcgaaatttatgaaattgcttatagcaaaaatcgtgaaactgtaaaaatagaatctagtaagttgatgcttcaattagaagaaattgaacgagatttaattgcgttagaattcttttgtggtgaagtgaaaactgttacaatcaatgattatattttaggcgaaattagctatctttataaggcgattattaatgattgaattgagttggtaccagtttaaatctcttatgacaaatgttaaaactgtcattgaagaaaatcagggtcctgaaaatattactattcgcgaaaaagctttaaagatagtatacagtcttgaagaaatacaaaaagatattgaatctatggcaaaatttattgatgaacctattaataaagtttatattcaagattatactgtaggtcaaattcgcgatttagcaaggaaaatttaatgtttgattttattatagattttgaaacaatgggaagtggtgaaaaagcagctgttattgatttagctgtaattgcttttgaccctaatccagaagtagttgaaacatttgatgaattagtttcacgcggcattaaaatcaagtttgatttaaaaagccaaaaaggacatcgtctttttactaaaagcactatcgaatggtggaagaatcaatctcctgaagctcgaaaaaatattgcaccatcagatgaagatgtaagcactatcgatggtattgcaaaatttaatgattacatcaatgcacataatatcgatccttggaaatctcaaggctggtgccgtggaatgtcgtttgattttccaattttagtcgatcttattcgtgatattcaacgttttaatggtgtttctgagaatgagcttgacacatttaagttagaaccatgtaaattctggaatcagcgtgatattcgtaccagaattgaagcacttctgcttgttcgtgatatgaccacgtgtcctcttccaaaaggaactttagatggattcgttgcgcatgattctattcatgactgtgcgaaagacatcctgatgatgaagtacgctttgcgatatgctatgggtcttgaagatgctccatcagaggaagattgcgatcctctatctcttccaacaaaacgataaaaagttgtttacttcctcggttagttgtggtattataacaccatagctactgaggataataaaatgaaaatttatcgtgttgaatcatcgtttagtattcttgattatgaagatgctataacaatacgtcgaaatctttgtgttcaaataacgccgtacaggagtataatagattcatggagcgaagagtggctattacacgtaggttatgacagacctaattttatgcatcatagcgataataataaaagaattcctttaccacacgaagataaactattagttaaaaacgctaatatagtaattaatactaagttcaagaaagattatgttggagtagaatatcatattccaggatggtttataggtctttatcattttgctttcgctagtgaatatgatatgatgagatggttcacacgagaagagcgtgaagaattagcttcgaaaggattttatcttgctgtatacgaagtaccagatgaccaagttatcattggcgggcatcaagtaatgttccgtaaatcccatgctgaacttgtagattttattgaaatgagataattatgaaatttaattataatcctgaatacacaccgaatccggcagctaaactgattgattttgacgttgtaagtacttatgtatgccctgttaaaccactggaaattaaggaacctactatgactaccgctattgaaatcggcaaaacctacaaactggttgaacctaaaattaaaactaatgccttgatttctggtcataaaactctgactgatgtttttggcgaaggcgaatttattgttgaagaatttgccaaaagtgagtggtttgacaaatcttacgtcatccacggtcgccggttagataataacaaaataaagaaaaacctggtttatgaagatgagttcatcctgttccaagaagttgaagaacaagaccctacagacctgttgtgtgctgctgtgtctatccgtcgtccttttgataatcctatctgtggttgggtaacagaccagtggattgaagatggtgttgagcttctgaacgttgtccatgcaggagattttagtgtagtacctcgtagtgcggtggtagctattttgaattaatagtttacaaactcttgggaccagagtataatggtcctgtggagtataaaatctttttaacaagtgagagataactatgattattaatattggtgaaattgctcgtgtatctgataaatcccgttctaaagcagcaggaaaattggtcgaaattgtaagcattcagcttaaacacggcgttaaagatgaagattctgaagtaaaagtgcgtatcattcctaaagatggaaagtctaaacctcagtttggttatgttcgcgcgaaatttcttgaatctgcgtttttgaaagctgttcccgctaaaggaattgaaacgattgatacttcgcatgtaggtgtagactttaagtggaaactcggtcaagctattaagttcattgctccttatgagtttgaatttatcgaaggtggacaaccacttcctcggcgtactcgcgctatgtgcgcatacattactgatcaatgggtagaagatggcgttaagttatacaacgcggtatttttaggaacatacaaagtcattcctgaaagttggattaaacactacagcaaagctcgctatgcataaagtttaaaattttttcataaaactatatacatcagtagttgattatggtactatatcaatatcaactactgatacagaaaacaacttggagaataaaatggataattcgttaaaggtgcgctgatactcttctgaaacgcatcgctccaatgttcaattaatgaggaaattatgatgaaacgtaaaattattcagaattgcactaatgatgaatttgaagatgtgttattcgatccagatttggtagtagttcaaaaggaacacactgctaagtttactcacttgacttcggtttatgtgtatgaaaaggttggggataaacaaccaatttacggtgtatttcgtgaaatcactgaagatggtacaacttactggaaggaaatttattaatggctattaaatttgaagttaataaatggtatcaatttaaaaataaacaagctcaagaaaattttattaaagaccatactgataacggaatctatgcacgccgtttaggtatgcatccttttaaaattttagatgtggatgctcttgggcgtcctattaaaattatgtcatttgctggaaatttagtactatcttctggtaaagatattttggatgaagattttatttggctttcatcgaatgaagctgaattctttaatgaagttgaaaatccataccaggcagctgaagagcaggaagaatctgcaccgataattgatcaatctaaattccctgtaatgaaagttactattgaaaatgatgaacaggcatggtccttgtatcagatgttgaaagctcactttaaggaataattatgccgctttatgattataaatgtcaatcaaaagactgcgcaaaagaatacgaaaaaatcaagaaaatttctgaaagagatactgatgtatgtcctgattgtcatcggattgctgttcggttagtttccgctcctagacatgtgaatggtggtttttacgacttgcttaaagggtgattatgtttaaaatcggtaagaaatatcgcattcgcgaaggtgaagaaaagaaatatctattttctgctatttataggaatggttctattagtaatgtaatatctacaagcgaatttatcgttgaagatatgaaaggtaataacgttacaatgattagtacagcatctggaaatgacggaaaaattcttcacagttttcagagtaatgttctaatatatgatgaagaatttaatctattcgaagaagttcccgaagattttgattttgaatgcactatcactatgaaatctggtgaccctctttcttttacagttaaagatgaaagaagccgcttgagagttattagtcttcttcaagccattaaatttaagtgaaaattatgaaatatattaatcgttctatcgcagcattagtattagcagtgtctttaataggatgtactgatgctgataatgcaaccaaagttttgtcttcaagtggttttactaatattgaaatcactggatataattggttcggttgctctgaaaatgatttccagcatactggatttcgtgctattggacctactgggcagaaagtagaaggaacagtatgttctggactattcttcaaggattcgactattcgttttaaataaaaggccttcgggcctttagctttatgattaccggagtataatattcccgaaaccaaacgaggataagtgatgattaagaatgaaattaaaattctgagcgatattgaacatatcaaaaagcgtagcggcatgtatattggctcttctgctaatgaaatgcatgagcgctttctgtttggtaaatgggaaagtgttcagtatgtacctggtcttgttaagcttattgatgaaattatcgataactcagtagatgaaggtattcgtactaagtttaaattcgcaaataaaattaatgttactattaaaaacaatcaagtaacagttgaagataacggtcgcggtattccacaagcgatggtcaaaacacctaccggtgaagaaattcctggtcctgttgctgcatggactattccaaaagcaggtggtaactttggtgatgataaagaacgtgtcaccggtggtatgaatggtgttggttctagtttgacaaacattttttctgtgatgtttgtcggtgaaactggtgatggtcaaaataatattgtagttcgttgttcaaatggcatggaaaataaatcatgggaagatattcctggaaaatggaaaggaactcgtgttactttcattcctgattttatgtcatttgaaactaatgagctgtctcaggtttatcttgacattacactggaccgtctccagacactcgcagtagtttatcctgatattcaatttacctttaatggtaaaaaggttcagggcaattttaagaaatatgcacgccaatatgatgagcatgctattgttcaagaacaagaaaattgttctattgcggttggtcgttcaccggatggttttcgtcaattaacatacgttaataacattcatactaagaatggtggccatcacattgactgtgttatggatgatatttgtgaagaccttattccacaaatcaaacgtaagttcaaaattgatgtgactaaagcacgcgttaaagaatgtttgactatcgttatgtttgtccgtgatatgaaaaacatgcgatttgattctcaaactaaagagcgtttgacttctccatttggtgaaatccgtagtcatattcaacttgatgctaaaaagatttcacgtgctattctaaataatgaagcaattctaatgccgattattgaagctgctttggctcgtaaattggcggcagaaaaagcagcagaaactaaagcagctaaaaaggcttctaaagctaaggttcataaacatatcaaagcgaatctttgtggtaaagatgctgacactactcttttcttgactgagggtgattcggctatcggatatcttattgatgttcgtgataaagaacttcatggtggttatccattgcgcggtaaagttctcaacagttggggtatgtcatatgctgatatgcttaaaaacaaagaattgtttgatatttgcgcaatcactggattagttctcggtgaaaaagctgaaaacttgaattatcataatatcgctattatgactgatgctgaccatgatggtctaggaagcatttatccttctctgctcgggttttttagtaattggccagaactgtttgagcaaggaagaattcgttttgtcaaaactcctgtaatcatcgctcaggtcggtaaaaaacaagaatggttttatacagtcgctgaatatgagagtgctaaagatgctctacctaaacatagcatccgttatattaaaggacttggctctttggaaaaatctgaatatcgtgagatgattcaaaatccagtatatgatgttgttaaacttcctgagaactggaaagagctttttgaaatgctcatgggagataatgctgaccttcgtaaagaatggatgagccagtagtttactttaccacaaggatgtggtataattaattgggcaaatgaggatattgaaatgaaatcatataaagtaaatttagaactttttgataaagcagttcatcgagaatatagaatcattcaacgctttttcgatatgggagaagccgaagaatttaaaaaccgctttaaagatattagagataaaattcaatccgacactgcaactaaagatgaattactagaagttgctgaagttattaagcgtaatatgaattaatgaggaaattatgattatcaccactgaaaaagaaacaattcttggcaatggttctaaatcaaaagcatttagcatcacagcatctcctaaagtatttaaaattctgtcatctgatttgtatacaaacaagattcgtgcagtagtccgtgaattaattactaatatgattgatgcccatgcacttaatggaaatcctgaaaaatttatcatacaagttccaggacgattagatccgcgatttgtttgtcgagattttggtccgggtatgagtgattttgatattcagggtgatgataattctcctgggttatataattcatacttcagttcatctaaggctgaatctaatgactttattggcgggtttggtttaggttctaaatctccgtttagttatactgatacatttagtattacttcgtatcataaaggtgaaattcgtggttatgtagcttacatggatggtgatggtccacagattaaacctacattcgtaaaagaaatgggtccagatgataaaactggtattgaaatcgtagttccagttgaagaaaaagactttagaaactttgcttatgaagtttcttatatcatgcgaccattcaaagatttggctatcattaatggtcttgaccgcgaaattgattattttccggattttgatgactattacggtgtaaatccagaaagatactggcctgatcgtggtggattatatgctatctatggcggtattgtttatcctatcgatggtgttattagagaccgtaactggctaagcattcgcaatgaagtgaattacattaagtttccaatgggttcacttgatattgctccatctcgcgaggctctttcactggatgatcgtactcgtaaaaatattattgaacgagttaaagaactcagtgagaaagcatttaatgaagatgtaaaacgatttaaagaatccacatctccccgtcatacatatcgtgaattgatgaagatgggatattctgctcgagattatatgattagtaattcagtcaaatttacgactaaaaatctgtcatataagaagatgcaaagcatgtttgaacctgatagtaagttatgcaatgcaggagttgtgtatgaagtaaatcttgaccctcgactgaagcgcattaagcaaagtcatgaaacttcagccgttgcatcaagttatcgtctgtttggtattaatgcaacaaaaattaatatcgttattgataatattaaaaatcgtgttaatattgtccgtggattagcacatgcgttagatgatagtgaatttaataacactttgaatattcatcacaacgaacgccttctgtttattaatccagaagtagaatcgcagattgatttgcttcctgatattatggcgatgtttgaaagtgatgaagttaacattcattatttgtcagaaatcgaagctttagttaaaagctatattccaaaggtagttaaaagtaaagctcctcgtcctaaagctgctacagcatttaagtttgaaattaaagacgggcgctgggaaaaagaggaattatttacgctcacatcagaagcagatgaaattactgggtatgtagcgtatatgcatcgttctgatattttctctatggatggtactacatctctttgtcatccatctatgaatattttgattcgtatggctaatcttattggcattaatgagttttatgttattcgtccgcttttgcagaaaaaggtaaaagaactcggtcagtgccaatgtatttttgaaactctgcgtgatttatatgtagatgcttttgatgatgtagattatgataagtacgtaggttattcaagttcagctcaacgatatattgataaaattatcaagtatcctgaactagattttatgatgaagtacttcagtacagatgaagtttctgaagaatatacacgactcgctaatatagttagttcattgcgcggtgtatattttaatggtggaaaagataccatcggtcatgacatctggacagtaactaatctctttgatgaattatcacgtaatgcttcaaaaaatagtgataaaatggttgctgagtttaccaagaaattccgtattgtttccgacttcatcggttatcgtaactctttgagtgatgatgaagtttcccaaatcgctaaaactatgaaggcccttgcggcctaataaggaaaattatgtacaatattaaatgcctgaccaaaaacgaacaagctgaaattgttaagctgtattcaagtggtaattacacccaacaggaattggctgattggcaaggtgtatcggttgacacaatccgtcgtgttttgaaaaatgctgaagaagctaaacgctctaaagttactattagcggtgatattacagttaaagttaatagcgatgtagctattgctccagttgctaaatctgacattatttggaatgcatctaaaaaattcatttcaattactgttgacggtgtaacttataacgcaactcctaatactcattcaaacttccaggaaattcttaatctgcttgtagcggataagttggaagaagcggcacaaaaaattaatgttcgtcgcgctgttgaaaaatatatttctggtgatgttcgaattgaaggcggaagcttgttctatcaaaatatcgaattacggtctggtctggttgatcgtattctcgattcgatggaaaaaggtgaaaactttgaattttattttccgttcttggaaaatctgctggaaaacccaagccaaaaagcggtatctcgactctttgatttcttggtagcaaatgatattgaaattacagaagatggttacttctatgcttggaaagtagttcgtgacaactactttgactgtcactcaaacacctttgataacagtccgggtaaagtagttaaaatgccacgtactcgtgtgaatgacgatgatacacaaacttgttctcgtggtctgcatgtgtgttctaaatcttatattcgtcactttggcagttcaactagtcgagttgtaaaagttaaagtacatccgcgtgatgtagtatcaattccgattgattacaacgatgctaaaatgcgtacctgccaatacgaagtagttgaagacgttactgaacaatttaaataagggcttcggcccttaactaaggaaaattatgttaggttatcaagcacgagtaaaagaagaatacgatcaattaatgctcaaaattaatgcactgagcaaatttttagaaagcgcaaagtttctaacagttaatgcagttgagcaagaactgttactttcgcagtttatctcaatgaaatcttatgctgaatgtctagagaaaagaattgcacaattcaaataaaataagggcttcggcccttttgttttaagagaaattatgatttattatatgaatactagtgattcagacataaaaggaaagtttaaatgcagaaaacgaatccggggttacagagactatttcagattccgacatttaccctatcgaacagtgacttgactagtgaaatgaaggtcaaaattgttgatactgcaagatactctttaaaacaaaacccaaatcaggataaggcagaagttatcgaaagatgccgtatcgctgtgtacgcagagttttttgtagcagattggctgagcgggtatgttaacaaaggtcaagaagatgtcgatgatccgtacacatatgcatgggatgtattggcgcatccaagatactgcgggcttcgtgtagaagttaagacacatcaaactgactcacgttggatttcggtgacaacaggatgcagtggagagtatccatatggttctggaataaatctagggcccattctaaatcatcaagtcgctgactgtataattatattcaacactaaagaaattcatccaggtgtcatccaatacactccgaagttcatcggtgatagagaagaccttcgtaaggttgtaagaaaaagcaactacagcggatggtatctttccatttaaaaaatttcacaaaatggtttacataccacaaggaccgtggtactatacaactatcaactgatacggatttggagagtaaaatgaaatttaaattttattatgctaagcataaaataactgatgagtttgtgtcagttgaatattctagcgatgatgaaggcatgatttatactcgcttaggattatcgcattgggagtccgatcagccttatttttcaactcctgaagaaattacacgcttagttaatggtcatatgaatgaccactggaatgtaattctttcagatagtcttaaagaggctattaatagtaatgaaatgaaaatcgttgagattgaactatgagttcattatggtggtgttttgtttggttaattagtattccagtaatttgtttaacatttacttttgtgatgaggttattatgaaaattttgaattctgtacttattgcttgtgcgtggtgggttgcacaggtttcagcggtagtagttggtattcacatttattacgaatatttttaaaaaagttgtttacaagactgttcttccgtggtactattaccctatcaactacggaggaacagaaaatgaaaaagattattaaagctatatggaatgtagttataatactaatagttttgagtatattcccaatcgttttaatgattgatgtattaaacgtttactttggatttatgtgaggaaaatatgaaacgtaaacgcaatgcttttacatttattgaatggtttttcgataatatttttccggctttattcattttcatgctgatttttgccttaggttcagttgtagttggaatctatttgatgacagtagtcggaattgatattcatcaaaatggtttaaaatccgtagttgaaacaatttggaatggtgtaaaatgatgaatttgctgagcggttggttttatattctcatgttttacattggtgcaaatttcccatattggatgggatggtcaacaactgcattcggattttatattccttgaggtgaattatgaaaatttttaaagatgtaaaagttggtgaaattttttgtttagataacggtgatcagttaattcgtatttcacctcttaagagcactagcgagaaaccgacagttaatgctactttagcaaataacagtaatgaacgtttctgtattgaaaatgatactgaaacttataccgtagaagagttttgggaattgagcgtcgactgcgacgattaatttaatggccgcgtattcatgcggccttggagtagaaaataatttagaggaaattaatatgaaatacatgactgttactgatctgaataatgcaggcgctactgttattggtacaatcaagggtggtgagtggtttttgggaactccgcataaagatattttatctaaacctggattttattttttagtaagtaaattaaatggtcgtccatttagtaatccatgtgtgtctgcacgattttatgtaggtaatcagcgttctaagcaaggattcagtgcagttctaagtcatattcgtcaacgtcggtctcagcttgcacgtactattgcaaataacaatatggtatacacagtattttatctgcctgcttctaagatgaaacctctgacgacgggatttggaaaaggacagttagctttagcgtttactcgtaatcatcattctgagtatcaaacacttgaagaaatgaaccgtatgttggctgataattttaaattcgttttgcaggcatattaatgagtaatttccacaacgaacacgtgatgcagttctatcgtaataatcttaaaactaaaggcgtcttcggacgccagtgaggaaaatatgaatatcgcaaaattattaggagttatttcatttatttgttggatagtagcatgtgttttaactatctgtatcgatgctagcagtgtgttttcacaagctttagcccagggtatgtgtgcatatttaacatttgtgttgttatctactaatgattaagaaaatcttgggctattcattagcccttgctattttattgatagcattatattacggaataatgttcggattaattcaagtcgtgcttttcatttctgatgttattatggcactacattcactagtatggtaaatttatgcaactgaataatcgtgatttaaaaagtatcattgataatgaagcattggcttatgctatgtacacggttgaaaatcgtgccattccaaatatgattgacggatttaagccagttcaacgatttgttattgctcgagctcttgatttggcacgaggaaataaagataagtttcacaaactcgcttctatcgcaggcggtgtagcggaccttggatatcatcatggtgaaaactctgcgcaagacgcaggtgctttgatggctaacacttggaataataactttcctctgttagacggtcaaggaaacttcggttctcgtactgtccaaaaggcagcagcaagtcgttatatttttgctcgtgtaagtaaaaatttctataacgtatataaagatactgaatatgctccggtacatcaagataaagaacacattccgcctgctttctatttgcctgttattcctactgttcttcttaatggcgtttccggtattgcaactggttatgcaacttacattcttcctcatagtgtttcttctgtcaagaaagctgtactgcaagctcttcaaggaaagaaagtaactaaaccgaaggtagaattcccagaatttcgtggtgaagtcgttgaaattgatgggcaatatgaaattcgtggaacatataagtttacttcacgaactcaaatgcatatcactgagattccatataagtatgatcgtgaaacttacgtgagtaaaatcttagacccacttgaagataaaggcttcattacatgggatgatgcttgtggtgagcatggctttggcttcaaagttaaattccgaaaagaatactctttgagcgataatgaagaagaacgccatgcaaaaattatgaaagacttcggactgattgagcgtcgttctcagaatattacagtcattaatgagaaaggaaagctgcaagtttacgataacgtagttgatttaatcaaagacttcgttgaagttcgtaaaacttatgtccaaaaacgaattgataacaaaatcaaagaaactgaatcagcatttcgtttagcttttgccaaggcacatttcattaagaaagtaatttcaggtgaaattgttgtacaaggtaaaactcgcaaagaactgaccgaagaactttctaaaattgatatgtattcttcttatgttgataaactagttggaatgaacatttttcatatgacttccgacgaagcaaagaaacttgctgaagaagctaaagccaaaaaagaagaaaacgaatattggaaaactactgatgtagttacagaatacaccaaagatttagaggaaatcaaatgagtccattcattggtatcacaagcgctgcattagtatctggtggcattttactggcgggtttaggtgttgttcctgccgtagcaggaggtcttcttgcgttcggaattcaacgtgttatcatgacagttatcacagtcatgcagtaattttagggagagccgaggctctcccttttttatttcaaaaattttttcacaaaacggtttacaaccaaagcatactgtggtactatacaactatcaaataaatgaactgaaacaaacaacccggagatacaaaaaatgaaatttaaaatcgaaaacgaaatcgttaaagctaaaaatgctctgactgctaacaaactggttgtagatggtattgaatatgatatctgtggagttcgtgaagaaaaacctggtgttctgactttcttcacaatgatttttaaatttaaaggtgacacagaattcaaacagtttgattttgcccatgaagacgaaatcgaagttcgtaatctgaacattaagtaagtactttattagagctcttgaaaaagagtgcaaaaaagtgtttacttctgctttaaacatgatactatagacctatcaaataaatgaactgaaacggagattaaaatgtctaaagtaacttacatcatcaaagcttctaacgatgttctgaatgaaaaaactgctgcgattttaattaccattgctaagaaagatttcattacagccgcagaagttcgtgaggtgcatccagatttaggtaatgcagtagttaatagtaatattggggtattgattaaaaaaggcctggtggagaaatctggtgatggattaatcattactggtgaagctcaggatattatttcaaatgcagcaactttatacgcacaggaaaacgctccggaactgctgaaaaaacgagcaactcgtaaagctcgtgagattacttctgatatggaagaagataaagacttcatgttaaaacttttagatgaaaatggatttgttcttaaaaaggttgaaacttaccgcagtaactatctcgctattttagaaaaacgcactcacggaattcgtaattttgaaattaacaacaatggaaatatgcgaatttttggatacaaaatgatggaacatcatattcagaaatttactgacatcggaatgtcatgtaaaatcgctaaaaacggtaatgtgtatcttgacattaaacgctcggcagaaaacattgaagctgtaatcactgtagcatctgaactgtgaggaataaataatgaacaagttagaaattgttaatgaacttcgtcgttgtgcagaacctactcaagagggttgggatatttggtaccatggagcttatcttggaactattgtaaagattaagactggtaaatacatgattattcgtgaaagtaaagatgctccagtaggtattcgcaataattttatggcagcgataagttcatttacggatgcagcttacgaaatttaccttgctgattataaagaattccaggaatctcaaccagttattcgttcaattggtgttaacaaagctcaacagaaaactttatggcaacgtattaaaggatggtttaaatgaaaacatttaaaattgtcgtagaattttataacggcgaaggtgtagtccatcttaaagcggccaaccagtttgatgcggtaagagtatattgtcaatgctttgaaagttctaaacaagctataaaaattaaaagtgttgaggaaaccaaatgaaaaccttcaaagagcgtcttgaattattagacctagctttattacgtgaaactccagaaagtctagcagctaaattacaggcctatggcgactacaccgaatatacggaagaggatgttttagaagaggttcctgaaatctgttggcaagtagctcattggaacaataatgaaaaatatcaacgtcgaattgtgtgtgcagccaaccgctttaagttaaaagatggtgggactctggttattcctggtgctcgtcattattctaaagatatggctgaagttcttgaccaggtaagtgataaacttgtatcagaccatgtttgtggtgaagaccaaggatttattgaccagtatagcaattactggacacgtgaagaagcaatgattattgcaacttacgctggacaagtgcgtattgaacgtggtggtagtgaaaaagaactttactctgaggacctttactaatgaatattaaaaagtttcaaattgatggaattaagaatcaaatccaggcgttggaatatgccaataaaatgatgtcaactaattggggaatttatgccaatgaaccggcatttcagttctgtgatatggaattcaccaaaaagctcgtaggaaaagattatgtatgtccatttagttctccagtaaatggaatgttaaaacctgctttacgcgatctttatattgcgatgaacgaagaaatgataaaagaactaaaacgtcaactgaaggtgattcaatttggccagggaaattaattcaaaatctgattattttaattctctcaatgataaagataaaaatctaataaggcattttattgttgagatgggatatactgatacacgtgatttaagagaacatatatttgaatgtggtgtagctaaaaagttttcattcacatgcaaatgtttaagagaggtaattcagcactatgaacaatttagtcgcaaagcataattttaataaagcttctgttcataaggataagaagaaagcgtttaaagaatctaatcgcaaacagaaacataaggggaaggtctatgattattgattctcagtctgtggttcaatacacaatcaaaattgatattctagaaaagctatataagtttctaccaaacctataccattcaattgtcaatgaattagttgaagagttacatcttgagaataatgatttcttgattggaacttataaagacctctcaaaagcaggatatttttacgtaattccagctccaggaaaaagtattgatgatgtattaaaaactataatgatttatgtccatgattacgaaattgaagattatttcgaatgagtcataatcttgaaatggtaatcgagcataatgtagctcaggaacgcgagtcgttcaaggaattcgtagaaaaaatttttgaagaaaataacacagaccagtttacaaatcaagcgtctgatgatattataacaaagtcaactaattgagtggtatagttaatgaataaaaacattgatacagttcgtgaaattattactgttgcatctattttgattaaattttccagagaagatattgttgagaatcgtgctaattttattgcatttcttaatgagattggagtaacgcatgaaggtagaaagttaaatcagaattcatttcgtaaaattgtttctgaattaactcaagaagataagaaaaccctcatcgatgaattcaacgagggttttgagggtgtatatcgatatctagaaatgtatacgaacaaataattatttagcccttcctaatattctggccgcctgagcacatattgattcaaggcggtcattacttatatgatcatttctataccagtacatggttatcgttccagcatagatattatccaaattaaaatatggacaactgtacatgtagtttatttcgggagtaggctttttagttggtaaaaaagcaaattttgagtcggaataataatgacgtccatttaaatgaactgcatattcatccatagttttatcaacaggatatcctccaagtgatttttcgcttattgttgaaggtaattttccttcgtatgctataatatcaacaaaatagtttaagtttttagggcggaaagaatataccgcactaaagtctgcctcagatgatatatgaactatctggagttgttccagggcgacagattcaaagcgtgcatttctttccttttcaataatttcgctgtatgtttcatactttgattgcttatagtactcaaagaaactatctcccctataccaaacaatcgccatcataaataaaagaattacgacagctacccgggaagcaagaacattcccggtagcgttatctttgaacaagcgatctagaacacccaacagaatatcagagggcgaaaatgatattctaggtgctgccatagaccctccttttaaggatatttattcaaattatactcttggaccatatattgctccaacgttttgccatgtcggcgtagaccctatgacggcataaccggcagctccgccatcgtattcatatccttgacgacgaatattacatctacctcccgctgaacctacttcaccgccgtttccaccattatatataccattcacggatcctgagccaggtgcagaaatagtaccgccagtcgcgcctgattgcatattaatagatccgcctggcgcaccaaaaggacgaccgccaccgccgccaaaggccaatctcattcgtgaaaaaggagaataatatccg

SEQ ID NO: 7 - DNA, 166781 bp, Escherichia phage
  source 1..166781: mol_type = genomic DNA; note = ES19
atggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggttcaatgtctgcggaagttttagatcgtactaagcaagcaattgaactgcttcctgactttttacagccaggaattgttgaatggaataaagggtctattgaacttgataatggttcctcaatcggagcctatgcttcctctccagacgcagttcgtggtaactcgttcgcaatgatttatattgacgaatgcgcatttattccaaacttccatgattcctggcttgctattcaaccagttatttcatctggtcgtcgttcaaaaattattattactacgactcctaatggattaaatcatttttatgatatttggactgctgctgttgaaggtaaatcaggatttgaaccatacactgctatttggaattcagttaaagaacgtctttataatgatgaagatatttttgacgatggatggcaatggagtatacaaaccattaatggttctactttagctcaatttcgtcaagaacacaccgcagcatttgaagggacttccggtacattaatttcaggaatgaaattagctgttatggatttcattgaagtaactccagatgatcacggttttcatcgatttaaaagccctgaaccagatagaaaatatattgcaactctagactgctcagaaggtcgtgggcaagattaccacgctttacatattattgatgttaccgatgatgtgtgggaacaagttggtgttttacactcaaacactatttctcatttaattctacctgacatcgttatgcgttatttagtagaatataatgaatgcccagtttatattgaattaaatagtactggtgtgtcagttgctaaatcactttatatggatttagaatacgaaggcgttatttgcgattcatatactgatttaggaatgaagcaaactaaacgaacgaaagcagtcggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagttgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatatcgatgactttttcgcaaaaggtggttcagaatatatttttgcaactgcacaaaactggccagaaggattctctggaattttaactctttctggtggattatcatcaaatgctgaagttacagcaggagatttgatggaagcttgggacttctttgctgaccgtgaatctgttgacgttcaactgtttattgcgggttcttgtgccggtgaatctttagaaacagcatctactgtccaaaaacacgtcgtttcaattggagatgctcgccaagattgcttagtattgtgctcaccaccgcgtgaaactgttgttggaattcctgtaactcgtgcagtagataatttagttaactggagaactgcggcaggttcatatactgataataactttaatattagttcaacctacgcagcaattgatggtaactacaaatatcagtatgacaaatataatgatgtaaatcgttgggttccattagcagctgacattgctggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgtttgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacatccaaccggctagaagcattaactacattaccttaaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaacgaagctgcttctccttataatgctgcattccaaacaatttttggttcatatgaaccaggaatgaaaactactcgtgagcttattgatacatatcgtaatctcatgaataactatgaagtggataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgctgaagcgcaaaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgctgcaggtcagacttctggagcagtaactcagattggcccagctgttatgggtatggtacgtcgtgctattcctaacctgattgctttcgatatttgtggtgttcagccaatgaacagcccgactggccaggtattcgcactgcgcgcagtatatggtaaagacccaatcgcttccggtgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagaagttaaacaaattgattcaggcgcatctgacgcagacaaattagatgctgaaattaagaaacaaatggaagctggtgtactggtagaaatcgctgaaggtatggctacttctatcgctgaacttcaggaaggttttaacggttctaccgataacccatggaatgaaatgggcttccgtatcgataagcaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgctggcgaagctgggtatgtagaccgagaacaaatcacagaattaacagaagagtctaaattaactctcaataaaggcgatttattcaaatataataatatcgtttataaagtattagaagatacaccatttgctgatattgaagaaagcgatttagaattagctcttcagattgcaatcgttcttttaaaggttcgtctattttctgatgctgcagtaacaagcaaatttgaaaactctgatagcgaaattgcggatgctagattccagattaataaatggcaaaccgcagttaaatctcgtaaacttaaaactggcatcacagttgaattagcacaagatttagaagcaaacggattcgatgctcctaatttcttggaagatttgcttgcaactgaaatggcggatgaaatcaataaagatattctgcagtctttgattacagtatcaaaacgctataaagttacaggaattactgatactggattcattgatttgagttatgcatctgcacctgaagctggtcgttcattataccgaatggtgtgtgaaatggtttcacatatccagaaagaatcaacttatacagcaacgttctgtgttgcttcagctcgtgccgctgcgattcttgctgcatcaggttggttaaaacataaaccagaagatgacaaatatctttcacaaaatgcctacgggttcttagctaatggtttaccgctttattgcgataccaacagtccattagattatgtaatcgttggcgtagtagaaaatattggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacactgtagcaaaagatgaaaaagaagcaagagtaattgatggtggagatatggataaaatggcgggtcgttcagatttgtctgttttattaggtgttaagctaccaaaaattatcattgatgaataaaacaaagggaccgaaaggtccctttttatttaacttaccaattcaatccaagccggacgaagtacatcttgtaccattttaactaattccttcttaatcaaagaaggattatccgcttgagttagagtaataccttcacgagaagtttcttccaaaatatcttgaacagttagccccatcacctttccaaaatcttttggaccaatttcaccaattttagaaataacgttatttactcggttcagtgtaacgtaacaagctaaaattccaaccaatttgttatcagcttctgacagttcaactttagctttaataggcttatcagactttttcttttcactaaatttagagttcttgcatttgatagctacgcgattgccattaggcatccaagaaggataacaaggtttcaatacatatccttcagcggtaaatacttcgccttttacttcagcattccaaacgcatttatttgcatcaactaatccagcatggtctaccgtaaaattataatcctggacgacagaatctaaatcatttggcaatttaataagttcttcaaatttaccgcgacctaaaagtggagccattttaaatttaaatgtattgcagaatgattccatcatataatcatcgacataagtcacatcaccactttctgtagtaacaataatgtcaaatacataaaaatctttatcgccataatcgacattcttctgaatgccaggtccagcgaattcgccaaaaacttgataagatacaaccgctgaagtttccataatatcttgtactgctttaatggaatcagagtaattcttcaaaataatttcatacccaaagaaatcttcagcaggaagaataggaccagtgcgtttagcgcaagttactttatcacgctcaataatcaatgagaaatttgtgccgtgaatcttttcacgagctacccactccccaccagtcaatcccaagctataaagtttttcaataaatttagagttgtaatgattttcaagactgctatactttttaaacataattaatcctcaaaatgtaatttctaaccaatcaccatcacgctgatcactattgactttaaagctaaatccttcttttctcagccaatcaccaatttcttcagtaatcaatttatcgcgagcagtacaataataactaaaatatgttttaccttgttcagctgctttattagcaagttccgaaaaatctttaataaaacactctagcttaaactgtttacttttaagtgctttttcgcgtaatcgattagcaaaagattcattttcataaagatcatactgttccatttttcaccttttattaatatgtctttttatatagacaactttttctcgagtttcaaatttattcttagcagtcatagctcgagcccataatacagccacttctttcgcctgtaagtttaattcacgagcaatttcaatgaatgactttccagactcatgaagagtaaacaccacaacctcagttctcataatcaatctcatgttatcgagttgatgccattatatacatcattttctgagtatgttttgtgtgctttcaaaatgaagaaaggggccgaagccccttatgattatgattatgattatggataggtatagatgataccagtttctaaagcagttttatgaatgatgtatccattgcgtgattcttgaacatcaacttctggatagtctttcatcatcttctgaagagtgtaacgatgcaggtagtatttactgtctggatcttcagttttccaatctttaccttcttcggtcattttttggatttcatccataacccaccaaccgcaccagatataagctgaagtacgatgtggaagaggatgaacataaggtagttcaccttctggttcaattggagtccgttcagcaataacaacttcagctgttgaactaattgtctttgaagtgtaattatctttagttaatactgcttcaactttaattgtatgagtacccgctgaggaggtatcaatactataagtattagtagaattactttctgctacgttgtctttcttccaagagtacacaatattagtatcaccaggagcaccagtaacagatgctgttaaagttgcagttccaccaacagtagtattaactgatggcggagataaagaaatggtggcactattaaatgtcgcattattagttactactgttgcttctgctgaaatttcttttgtaacataatttgttgcagaaacagatgcggtgcatttaagagttttacttccgacttcggtcggagtgaatttatacgtagcagaagttgcatccggaatattactgtcatccattgaccattggaatgttatagtagcacctgaaggtgcactagagacatttgcagttaaagtaataggaacaccaaagactgtagtcggagactcgggtgtaatttttagcgtcgaagaattagcctttttatttacagtcaaagaaaccgctgatgattctactgttttatcaacgtaatcagttgcagtcactgtgacagagcaagttatagacttagttccttcagttgttggtgtatattcaaaggttgattgcttttgaccgtcaacatcgaccccgtcaactttccatgtataatcaatagcagcaccaataggttgattgcttacattagcagtgaatgttgttgctgttccaatttctactgccgcaggagaagccggagtaacagtgatagtggaattattttctttcttattaacagtgatagttgttgatgcttcagctatttccggatctcctgcggaaagtgtattagttgcaaccactttaattttttttgttcctgctggagaagcaagagtataatccattgtagcagccgtagagccctgtgttatatcatctacagtccagacgtatgtaatagtaccgtctggggtttcacctgcaggtgtagcagtgaatgtttgtgaacctccaataacccctgtaggagttagaggagataacgtgacagtgaatgccataagttatccttattttaatgttatgaaagaagaattacgagtttcgcgaattagaactgatccatcgcgattaatataataaattaagctaaataatgtttggtgtgctgacgcatgttcaaaactagttgggtgagatttccaatccggagtttcagcaatccattgataaatccaccaaggaacagtgcagaatcctggattttttccaatcagttgaagattcggactaaagttttccggaagagtaaatacagacggcttttcagattcaataatctcagctacagcttgttcaaacttttcttcaacaaacggagtgtcttcaatcaaaactgaggtattttcaggaattttatccgtttctactacttcaattttaatgtcagatttaaccggagaatcaatcaaaagtgctgcttctggattgacttcttcatcgtcatattttaatccctctgcggcatcagcagcatcaattaagtctttaatagataacccatcagtctccggcataggttcactagcgagcttctggagggcttcttcaatatcaacaacgatattatcaaaagatttattctttttgacctttataccaaactgttcagcatattcagctaatttagctttagcttctttgttatcatcaagagccttcagctctgcaatataatctttatctatcataatatttcctcagtataaatatagatatatttattacatggtatttagacatgactgacattaaagtacatttttatgattttagtcacgtgagaattgattgtgaagaaagtacatttcatgaactccgtgatttctttagctttgaagctgatgggtatcgttttaatccgaagtacagatatggccactgggatggacgaatccgtctgttagattataatcgtcttcttccattcggcttagtcgggcaaattaaaaagttctgtgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgcaggtaaatctttaattcaagctttgcttgctcggtattatttggaaaattatgaaggcaaaattcttattattgttccaacaactgctctgacaactcagatggctgatgactttgttgactatcgtttattcagtcatgcaatgataaagaaaatcggtggtggagcatcaaaagatgataaatataaaaatgatgcaccggtcgttgttggtacatggcaaactgtagtaaaacaaccgaaagaatggttctcacagtttggaatgatgatgaatgatgaatgtcatcttgctacaggaaaaagtatttcatctatcatatcaggtttaaataactgcatgttcaaattcggtttgtctggttcattacgtgatggcaaagccaatatcatgcagtatgttggaatgttcggtgaaatatttaagccagtaacgacctctaaattaatggaagatggacaagtaactgagttaaaaattaatagtatttttcttcgctatcccgatgagttcactactaaattaaagggaaaaacttaccaagaagaaataaaaattattactgggcttagtaaaagaaataaatggatcgctaaattagctattaagcttgcacaaaaagatgaaaacgcttttgtcatgtttaaacacgtatcgcacggtaaagctattttcgatttaattaaaaatgaatacgataaagtttattacgtatcaggggaagttgataccgaaacccgcaatataatgaaaaccttagctgaaaacggtaaaggaataattatagtagctagttatggtgtattttctactggtatttcagttaaaaatctgcatcacgttgttttagcacacggtgttaaatctaaaattattgtattgcaaacaataggtcgcgtattacgtaaacatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcacgggtggtcggccaggatacgaatatcctgacgcttaagattatgctttttcattaagaattgaatttccgtttcaaattcttcttcataattaaaagcatcatcaatgctatatctcattattttccagcctcaaatgctcgcatgtcttgaatatgcttaatagcaaatccacgtgatttaatagcatcaagagctccgctacagaaatctaataaaatcccccaatactgtaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaatacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcaccaagtgtataccaaaggtcttctggtgcatctatttgtgtatgtaatagatttatatgggttggtatttcagttccgcaggtgcacttccaggagttttcgtgattaacttctccaagagaatgcgcccataaatgaatcaacaatagttctgattcttggcgatttaaatcttttgcatttgtgcagtctttgattagctttttaacaattacttctacagaaccattatttttggcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaaataattactgatttaattgatgattattttggagactatccgaagacttggcaaccatttatatttttgcaggtatttgtaggttcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtagatgaaatgtggtatgattggaaggaaattagtgaatcgagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgaaatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctgcagttttatgattctaaaaatatccacacaaaaatggatggaaatgaaataattcaaatttctgtagctaatgcaaacgatattaataatgttaaaacacgaatttatggatgcaagcatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagctgtaggaagtgacaaatttgtatttgtgtggcaagacatcatgggagttaacatgatggactatgatatgatgataaatcaagaaccatatccaatgattgtaggtgagccatctttaataggtcaattcatccaagaattaaaatatccattggcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttataggaatggctatgaagaagctattcgtcttcaaactatggcgcaatatgatggctatgctaaatgttctactgtcggtaattttaacttgactcctggtgttaaaattatttttaatgatagtaaaaaccaatttaaaacagaattttacgttgatgaagttatccatgaattatcaaataataattcagtaactcatctatatatgttcactaatgcaacgaaactggaaacaatagacccagttaaggttaaaaatgaatttaaatctgatactaccactgaagaaagtagttcttccaataagcaataaagaagtttctattcctaaaatgggtcttaaacattataacattttaaaagatgttaaaggccctgatgaaaatttaaaacttcttattgattctatttgtccgaatttgtcaccggcagaagttgatttcgtttctattcatttattggaatttaatggaaagattaaatctcgtaaagaaatagatggctatacttatgacattaatgatgtttatgtatgccaaagattagaatttcaataccaaggaaatacattttattttagacctcctggaaaatttgaacaatttttaacggtgagcgatatgttatctaaatgcttgcttaaggtcaacgatgaagttaaagaaattaattttcttgagatgccagcattcgttttaaaatgggcaaatgatatttttacaactttagcaattcctggccctaatggtccaataactggaattggcaatattattggattatttgaatgaaaaagccacaagaaatgcaaacgatgcgtagaaaagttatttcagataataaaccagttcaggaagcggctaaatccgcttctaacactttatctgggcttaatgacatttctacaaaattggatgatgctcaagctgcttctgaattaatagctcaaaccgttgaagaaaaatcgaatgaaataattggagcaattgacaatgtagaaagcgcagtgagtgatactactgctggttctgagttaattgctgaaactgtagaaattggcaacaatattaataaagaaatcggtgaatcactcggaagtaaattagataaattaacgagtttactagaacaaaaaattcaaacagctggaattcaacagacaggaaccagcttagctgtagtcgaaagtgctattcccgttaaagttgttgaggatgatacagctgaatttgttggtccattattaccagctcctgaagcagttaataatgatcctgacgctgattttttccctgcccctcaaccagttgaacctaagcgagagtcaccggaagaaaaacagaaaaaagaagcatttaatttaaaattatctcaagctttagataaattaacaaagactgttgattttggatttaaaaaatccatttcaattactgataaaatatcaagcatgctatttaagtatactgtcagtgctgctattgaagctgctaaaatggttgcattaataatggctgttgttattggaatagacctactgatggttcattttaaatattggtcagataaattttcaaaagcctgggatttgtttagcactgattttaaaactttttcaagcgaaaccggaacttggggtcctttattacagagcatctttgaatctattgatgaaattaaaaagttctgggaagcgggagattggggcggtttgacggtagctattgtagaagggcttggaaaggttctttataatttaggagaacttattcagcttggaatggctaaattatcagcagcaattcttcgagttattcctggtatgaaagatactgctgacgaagtagaaggaagagcactggaaaatttccaaaattctactggagcatctctcaataaagaagaccaggaaaaagttgcgaattatcaagataaacgaatgaatgatgatcttggcccaatagcaaaaggattagacaaaattgcgaactggaaaactcgtgcatctaactggattcgtggtgtagataataaagaagcattgactactgacgaagaacgtgcagcagaagaagaaaaattaaaacaactttcaccggaagaaagaaaaaatgctttaatgaaagctaatgaagctcgtgctgcgatgattcgttttgaaaaatacgctgattcagctgatatgagcaaagactcgacagttaaatcaattgaagctgctcatgaagaccttaaaaaacgaatgaatgatccggatttaaataattcaccagcagttaaaaaagaacttgcttctagatttgctaaaattgatgccacttatcaagagctcaagaaaaatcaacctgaagcaaaacctgaaacttctgctaaatcaccagaagcaaaacaggtccaggtgattgaaaagaacaaagcacaacaagctcctgttcaacaagcatctccttcaatcaataatactaataatgttattaagaaaaatactgtcgttcataatatgacacctgtcacaagcacaactgctcctggtgtatttggtgcgacgggagttaattaaggaataatatggcaattgttaaagaaataactgctgatttaattaaaaagtccggtgaaacaatttcagccggacagagtactaaatcagaagtaggaactaaaacatacacagcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcaaataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaacagcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcaaagtaaaatattaggagcaatataacaatggggaccgaaaggtccccatattttatttacggaatgaaataaaagcagcaactgaaacaacagaggtttcttcaatataaacctcaatttttaccggagcttctgactcaaatttacctgttactacaccttggaaaatactttcagtctgttctggctttgaaaaattttcagaaggaaaaattccgaactttttatctgttccaaaaattttgataaattcatcataaactgcttcattaaaagcgttatcagcaggaataacgccttcaactacaagttcttgacctaaaaagcgtaaagaagatttcattttgtgttcctcatgttatgtcagtaagattactataacacaacacgagggacttgtaaactacattttgaactttttagacattccgttgatgttaaccaaagaagctaagatttgagaaacttcgctttcctcttcttttgattcttctacaaggaattgattaaatccagccattggacgaacttcaccagtttccattagatggtcgccatcatatactgattcttctaattgttcagaaggaggaacgattgtaccttcgattagatacttgttataagcagtttctttcataaagtaagtacttactttattaatcttcagtaaaattccacgtggtagaataacttcagcttctgacggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcgccggaatcatctagagccatatagtttttaccatgctcaccgaagatatttggtttaagcgatgtggatacgaagttcttgaaatagaacattttattttcaatgttatgacgcaaagttttaaaggtaacttcttgtccacggtaaagtgtagttcctggaggaagaactgaacctttagcgaatgcagaatcaagcgtctcaatatgtttaatagctcgttccatatattcttcacgggtagaatctggtttacccaaaaggaacgagttcatttcaacatatgaatctgcacaataatcttcaattacatcagattcagcttgagttaatccttttggagttacttcagtgcttgcgtattcatatgcctgagcagcagattcattaatcaatttataaatgccattcatgacaaattgaataatagctgtcttttcatctggcgtagctttagaacctttaaccaaatcattgataattttcttaataacatcaaagctattagaaatattaatatcagcaagatcgcttaaaattttatcagtcttataatcaaagaattctttattctttaaatattcttgagaaccttgatatgttatatcgctctgtaacttgatagatggatcacgtaaacgtgcatgggctaatgcaatatgatttcggaagctttcgagttcataatcactagatttaaaacgagaagcgcttctcataccgcctatagctcctttgctgaagtttgaaccaatttgaataacgccagagttcattggtccttctgctttatacaccggaactttagattcaaactcttgatatttcttagcagcgaagctatcaccctgaagtgaagcatcaacagtagaatattgagcttgtgctgctaatcgacgactaattttagttttctgaataacagcttggtccgtgcgcttatcattttctaaagcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacgataaaccataatatatgcgtactttttatcataatcccagatttcctttaaaagaacatatcgacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttctgtttaacatttgatgaaacaaatgatgcaaagtcaactctatcttctatatcacctgtcattgtaactacttcgccggtttccattaaacggtcaccgtcataaattactgattcggtgagttcttcggtggtcataacttcagcttgaataagcttgttgttagttttgactgttccatcattgtaagatgcatcagttattttattaactttgaccattaatccacgtggcaaaatgacttccatttcatttgaaggcgctaaacttccaccgggtaaaacaacattgactttatcagccccagtaataacccatccaattccgactaaattatcgctagaattaacaagcccttcatcatttttatcgatagaaatgtttagacgcttttcatctggtaaaacaccaacagctgaatcagtcatccaagtaccaaaaatgtttggatataatgatgttgatacaaaatttctaaaataaaaaactcgattttttaccattgcttcgtatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggcgcgtccgctggtttatttaattctgccgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgacgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcagttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagccacgacaattgtttctaagtaagctttcataaaccagttacctcatgaaaatcaccaaatacatcctcgaatgtattagctttagttttatcttcacgtaaacgaatcacaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcacctctaacttcagcaaaacaccgagctccatcagcttttaactgggcaaaggctggaaatttgatattcttattaatgcctttttcatcataagaacttgcaagcatttgaggttgttcaggaattaaacctggccaaactttgtttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccactaccactagtaagtctattaaaataccctgcgtcgccaggcttaatataactccacgtatggaatggatgcatctgatgcgagtgtgtataatatggatgatatggattataaggattaaatccaggagttctccaagtagtgttccaacgaaaagaatcgtttttaatcatcttctcaattacatcttttataactttttcactatcaaaactttctttattttccttcgatggaaaaagcttattctctacatcattccatgtataaactcgctgtgcagtttttggaatactgtcacgttcccctcgagccatccaataaacaggaacatttaatatttcacttgcgtgatcgcagtggtgagcgagatcgtcaatataacaaattacgttatatttttcttttgcctttttgaacaactcttcttttgaagaatcatgaccacacatcagtacttctgagaaggcaccaggaaaaagagcattcaaattaaattgacgattcagcagagcgtcaatagaatcacccaatgctgtaacagctacaaaattataatcttcttttaatttgttaattacacatagggcatctttatatggagacaagtatcgaataaaatccgaacgattgtatttttcaattagcttaacgccaagttcttcatcgcaattaaatagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcgcgaaagcctctgttttgaagcgctgcttcaaaatacgcatttgtgtataattctttccaggctggggagtatcttgaaaacggaactccaagccagaagagggtcccacggtcctgagctctagcataagaccttccagcttgttgggcggcaagcccggataacccaaatatacgacgttgttgttcaacatttttcaccttgcacccttggaggaatccttcaagacctccaaattgaatgccatccataacgaaaggccattgggcgaaattacttaatgcgcatgatggccacctaaaattgcttctaatctctaactcagacattttcaatgcttataatttcaacatcagcccaatgaccacagtttggtagacgaaattcaactggccagtcactgcctttttctaatataatagacttaacttgcggttcttcgtgttcatcagtatacggatttttatctgttactttatatgtgaccttaatgtactgaattccaaaaatcttattaattatattcatactaattcctttaatccgtagataggagataattcatcgcccatacgaaggtcttcatttccatctacccaagaaacaatataagcctcttttatttgaataccactccatttaaacgaaggtagaaccttagaaattaatccaggtataccaactccctttaattcaacagtttgacctaaaaagaatttcattaaaacctcatctgaaaaccgtgcgatttaacattaccgccattaatatcagaactattaatttcacgtgcaattgaagggtcaatgtcaatttcacgattgagtttagtgatagctaaagtatcgcgcccatttacagtacgaaactctaaaggacaaaccacatcaacgtagtttttaatcgattcgctagtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcatttttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcaacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgttttttcctttttgttaacagatgaattaataataacaaataattcttaaagcatttatttaccaataaattggagcaaatgctcaactttcataccattaacggaaatcaatttgtcaatagaaaaacctcgccatgcaccaagttcaacatcaaatactggaatcatgtcagtagattctttcctagtagattccgtcaatttaccagtttgcatggttggcataaagtctgcatcacgagtacctttcataacacgaatagtaccatcagacttttcaaaaactacgtttgaaacacccatggacaatttagttttcaaaatttcacgaattgctactttttgttcagtcgtcagtttcatttatttacctattacagttttaatatgagttgttccacgttctttaagagtggaaagtaatttttggcatttttctaaatcagatttccaactatgtggtctatcaatacaaacccagtttgacttataatactgcttccatttagagaaaaaatacttcttatactctacagcaaatgaaatgttctcgttggaataagaactaattgctgtgagttgtaccaaacgaaatttcattattcaccacagaattcgttgatattttcccagtttaacttattcaagtttttcttaggaacattaaacacttcaatacctgcatttcgcagaatatcatcccagccaggtttatttttatcatatgtttcgcaataaaccagctttttaataccagattgagctatcgcttttgcacaatctggacaaggagaaagtgttacatacatagtagcaccttcaatagaagagccatttcgtgcagcaaacaaaatcgcatttagttcagcatgaatttcatttttagatgaccattccgagtgagcactacgatgttctttcgccaagacaaaacgatcagttgaaccaaatgatacgcattcaggcttatgaccttgaatgatagtatgtttaggcttattcaacaaccaaccttgctcagcagcataatcacaacagttcacaccccctgcaggtgaaccattatacccagtagaaataatacgtccattcttttcaattactgctcctaccttccaggagcaacattttgattcctgcgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcgccaaccatctttttgtgaagctcaactggatacttcgtcacaataatagcatcatacacagaaggatgaatactattcactagagtgtcattcattaaagttattctaatgaactgtgctgtttcagagtcaagcgctctatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttactaattcctgtgcaaatagtttaactttttcttggaattctttaacagtaattggtttttcacttagcatgttgatcccagctccttactttcaacgtttttaactaatttgacagaaactaattcagcatcttgagtaatcattaccggaccttcttcatactcttcaagatattctagagctttatttttagcttcttccttcgtatcagtttgagcatagatataaaacatacaaccagtaatacctactactttccacttaatttctttatcagttttaatttcaaatttactggcagaatcatctttttgaacttcttcgaaaaaagaatattctaacatataagcaattgaaaataacgggctaactttataggattcgcccattacatcaacagctttataccagcagtcatcaatttcgcgtttaatgctaataacatttttcgcaggatctatttttactttaaatgaattttccccaataaactgggcaattcgtttattagccccgcaagtttcattaaaaatatctttatacccagttttaaagcgataaaccttatcttcttcaaaccattcgctcattttaatttcctcatttgttttgatagagctataatatcacaactctaccgtaaagtaaaccattaaatcgctttgaattccgcagtttgagattcaaagcgaatgtcgcctttgataactagctcagcatcaagaccgaatacaacaatgatatgcgcggaacctggatacaacgtaatggcaatagaatccacctggtctggaagcaaagtgttcaatacatgagtcacttgagcgtggattcgaagctcagctgcgttatcaagtttttcaaacatattattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaatagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttagacagttcaacaaccataggattgataacatcggtatcacacttctcaaggtcataaggaccgcggccgtccatttttgctaatgtgccatcaacatcaaaaataactgcttttggtttaccaggagtccctttatataccggaagaccgagatactctcgcatgcttttatacattgagcgtaaaacatcaatcggtactgctttagttccgcgttttgagttgcgtttaaccaattcagtccaaggaacatcaaacactttatgttcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattgtgctcacgccgtcctttgtacaattcagctgttgattgattcgctgatttactctgaacattggatgaaataaattttatcatgtgatttttaagctgatacatatcaagcccacgagctttcgcttcttttcgcagggctttacccgcatcatctaaagctttagcagggtcttcatcatttaatactattccacgatccaaatccatgtatactgcaccatgacatgcatcaatgtaaaggtctgagcattcaatataacgttctagcagagttttcatttatttttctcaactaatgattgaatataatcatgcaggtctttagatgctttaccccacttattttgatattcatttttgagattagcacgggattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatggcataccgacccaagctttaccatcaataactttaacttgccaagatagtttagcttcatcatatgactttatctgtacaggccaattaggatgaactgtttctttctttacttctagaggctttgtcgaacaaccagctagaagaccgatagataatattactgctgatagtctaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcatgcctcaacatcttctgccatatccgatgcgctacgatttggattactaattccaagacgatgttttcccgttaaaggattaacgatgatatagcatttacagttgttaatatgaacattaggttgagtctgattaatgaacacttcacaatcatacttagcgagttgattttctaaaaagactttcatctcttcaaccgcatcaggaagcatatcacgggcttgctcaagacgacgattttgatattctttaatggtcgttttccgcttgacttgcttagctaaatctttcttaagatcagtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgtgcttccattgcataagtctttctatctttaccacaatgcttattgtgacagtcaagaactaaaaacagagctcggtctaagtacttcagataagtcgtttcaaacgcctcaatttttctgtatgaatattcatcgtcagcgtacattgctttaagatcatctgatgcaccgtcaataatagtcttaaacaatttttctggattatctaatgaactttttgtactatgaagagacacataccagtcagacttaattttaaaatgagaaccatctttcatcacagcaacatagccttcgatgttttctgcatttttagcttcttctacccatttagggctatcgatttcgaatcgttcaactagatatggacgaagagcagcatctttataaatatcatcgtatgaaatgtattcacccgtttcgttttcacgaacattcagtaaaataattttcatttcttggtaagcaagaacgattctattcgttggagcaacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagatgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagcatgaattaatgcagatttagtagaatcagacgttttgtctttacgattaatagcagttctataataatttattcttttacgtaaatttttagtttttccaatataaacaagctcatcatttatagcaatagcataaattacgttatacttgtttggaatagatagttgttttatacttccgttgtcgtctaattctaactcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatctccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaagatgaagctgctcatcacgcgcaatgaacttcataatcttggcattaccttccatgatttccatgttcttatggaagttaaaagtgcatgcgaaagatacataaaaacgaatagcttctaaggcattaataacgtgcaaacagaggtaaagagatttcattaaagcacgtttagcttcggcttcttgtttaatagctcggtttaaacgaaagtcggcatcaggagattctttagatagttctacaaattctttagcattttcccattcacgagttttaatcagaacatcatcataataacgtccaatggattcagcacgtttcataatagcttcatctaatacaatctcatcaaataccttcgatggatcagtataaagatttcgcatgatatgtgtatatgaacgactgtgaatagtttcactaaaagtccatgtagcaacccacgtatcaaggcttgggtctgaaattaatgacataagtacagcagacggcgcacgaccctgaatgctatccaaaagtgattgatacttcaagttgttagtaaaaatattttgctgatactgaggaagcttattaaactgtgcagcatccatcattaagtttacttcttccgggcgccagaaaaatgataaggacttctctgtaagttcttcaaatactcgatgccgttgaatatcataacgcgcaataccaagacctgaaccaaaaaacataggttcttttaaaacatcaactgggtttgtattaaaaactgtgctcataaattttccacttagttaatagttggtgactcgtccgtgagtcaaattatatcataatttacaggatgaacaatcttcagcttttggagtttctatttcataatcatcagtaccagaaccatcacgggtattatgataatagaaatttttaatgccataataccatccgtatagcatgtcatcaatcattattgacattggaacctttccttttggaaaaatctgcgggtcatagtatgtattcgctgaagctgattgacatacccatttcagcataatagctacctgcgtaagataaggtttattacctttcttagctaatttccacgtataatcatataggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgacgaccagtcacaaacgtattttggagctgcgatttggtcaatctttttattgtaccagtcgataggtaattcgcctcgagaccaacgggtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttggtaacacctacgccaagatttcgacgctttttagctttttctgcttcaggaaccggatatccttggtaatccaaaagattatcaagagcacgaacttggacttctgccaattcattaattttatcttgatcttgccaatcgaagttatctaacacaaatgcagataacgtacacaatccaatttcggcatcaggactattcacatcatttgttggaatagcaatttcacaacacaagttactctgacgaataggtgccttttcacgaataaatggagtatagttattcgtattatcaatgaactgcacataaatccttgctgttcctgagcgttcagtcatgagcaattcaaacagttcacgggctttaatacgctttttacgaatattaggatctttttctgctgcttcgtataattcacggaaacggtcttggtctttaaaataagaataataaagttcgccacccatttcatgcggactgaacaaagtaatgtaatcattctttccgaatcgttccatcattaggtcattcagttgaacgccataatccatatgacggatacggttttcttctacgcctttgttatttttcaaaacgagaagattttcaacttccaaatgccaaataggataataagcagtagcagcgccgccacgaattccaccctgtgaacatgatttaacagcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcaatgaatctcctgcctcaataacaacgcatgaactgaactgtcgagtcggagtacggcaaccagccataataggagttggtaatgaaatctgtcgagtagatactgcttcataaaaacgaataacgtgttttaatctatcaacaggttcatcttgatgcaaggccattccaatagtcataaatgcaaactgtggagtttcataaatttgaccagtggttttatctttaactagatatttttcttttaattgcatcgccccggaataagtaaattccatatcccgttcgtgcttaatttttgattctaaaaatgtaatttcttctgctgaatattttgacaataattcggggtcatatttaccttcatttacacagtaagaaatatggtcaataaatgaacgtggttcatactgcccataaacatgcttacgaagagcaaacattaaacaacgtgcagctacatattgataatcaggttcttcaaccgaaatagaattcgcagcagccttaatgacaatagtctgaatgtcatcagttgtcattccatcacggagatatgatttaatattttcatataattcataaggatctactgatgttccctcagctgcccaagataaaactttaataattttttgcgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccgcggtgaatattgacatcaaagtcggatttatatttattcactacctggcatagacggcccgcgcggtgataattcgtcatattgtttttccgttaaaacagtaatatcatagtaacaatcagaagaagttttaactgtggaaattttattatcaaaatactcacgagtcattttatgagtataatattttttgccataaatgataataggctgatttggtcctggaacttctagctcacttggattaggaagtgtaaaaagaactacaccagaagtatctttaaatcgtaaaatcatatatcctcgcaattaaattgaaattacaccgccatctttcctttaattggcgggtgagatacatagttgttaagaacaaaattatgcggctttgcgaattgactcaaccaaaatacctgtgattctgtaccccattcatcgaattcatctggaaattttaattgcaattcgcataaatccataggttcacgacgcaaaatttctttacattgttctacgtgattcatatagatatgagtattaccaccagaaaatatcaaatctcccggaataagattacacatcttagctacaatatgaactaacgcagcgtatgatgcaatgttgaatggcaagcccaagaacacgtcaacacttctttgataccactgtaaatccaaatagccattacgcacattaaactgatagaacatatgacaaggaggtaatgccatttgcttaagttctgccggattccatgctgaaacaatttgacgcctatcatttggcagttttttaatacgatcaataacttctataatttggtctacaccgccaaaatcacgccattgttttccataaattggaccaagttcaccgctatggtatcctaaatcttttgcttgattttcgtaattttcatcccagactgttttgccttgaattaatgaattatgttgaattaatcgcaaatcatttacgttagtacttcctgataagaaccacaataactcagaaatacatgcattccaggcgagcttcttagttgttactgcaggaaaacctttagttaaatcccagcgtaatttagtaccgaacaaagcaattgttcctgtgcccgttcggtcatcagtttcataaccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacggagaactattaccgaaaatactgcaagcggattcagtgaaacaactgctataaatcttgtctttaggaactactaattgatagacacctttaataaactgaggaccctgccactttggctgtttcgcgtcttcttctaatagaatagggtaataattaaaattcatattttccgccacgtgttatttcatttatatactgattccgtaagggttgttacttcatctattttataccaatgcgtttcaaccatttcacgcttgcttatatcatcaagaaaacttgcgtctaattgaaccgttgaattaacacgatgccttttaacaatgcgggaaacaactacttcatccgcataaggtaacgcagcatataacagagcaggcccgccaattacacttactttggaattctgatcaagcatagtctcgaatggtgcattaggacttgaaacttgaatttcgccgccagaaatgtaagttatatattgctcccaagtaatatagaaatgtgctaaatcgccgtctttagttacaggataatcacgcgcaaggtcacgcactacaatatgactacgaccaggaagtaatgtagataatgactggaacgttttagcacccataatcataattgtaccttcggtacgagctttaaaattctggaggtcctttttaactcgtccccatggtaaaccatcacctaaaccaaatgctaattcgtcaaagccttcaactgttttagttggagaataagcgaataccaatttaatcattacgcaaatcctctttcgataaaccattcagtggctttattagcatcaaagaataattcttcatacgtcttttctttgttttcaaaaactgtcacacaaacacgttgacattctccacagtattcttctgacatactcaaagcatcagaaaacatttcattaaattcacttaaatcaggattatgcaatgcgttaaaaattgcataatcaaattcatcattcataaattcaaatacaaaaatcatattatctcctattaaaaaggatcaggaacatatccgctagctttaatcattttaattaacgttaacattcctttgttaactgctcgtgagatttcatcaaaaacttcatcactaaaaagttctaacacgcccttctgaacttttaatttacagccaacaatttcttcatcgcctacagtaaattcattaccaccaattccaccgaaaaacttaattacaccagttaactgtcttccacgagaatatgggtcgtgtgataaagtaatatgagtcaccccgggtacagttttaaattggcagcgaatatttacttgtgaaattccaattacatgaatgtcagacataatattttcctcaaatagactttttcacaattttccaatcagctttaaactgatcgacgtcagagtgataaatccaaaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacagagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaatgacaatagaaaaattgcaataattgggatcatcgtgaatacttgtgatactaagttcaggataacgattacgaataatttcttcgatatattcaaaatcaacgatgtcaatatcaactttagccatattattttcctctttaattatcagcagtattgccgatagttgtatagtaccatggaaggacaaggatgtaaacagttttgtgaaaaaatttttgaaataaaaaaggggacctctagggtccccaattaattagtaatataatctgttaaaggtcattcaaaaggtcatctaggtccgtgtcatcagcactagatgaactgccagagcttgagctcataaaatcatcttcagtttttgttttgaagtcatcaacattgaatgcatccaaatcatcagcaactttatcagctttcttagcggcagttgcagcggcaccacccattgcagcagttcccataacttgactgaacttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaaaccagaaacttgtttaactttcagtacaaagttagcaccttcccacgggcaagttacatcaaccggagtttcacccatttcaacatcaactgcaatcattgcattgattttatcccagattttcttaccgaaacgatatttaaatactttaccttcattttctggagcagctgggtcttttactacaagaatgttagcccagtaagaagttttacgtttaacaagaccgtactctttattgtcagtgttgtacagatcatttttactgatgtattgacatactgggcaagaatcgtaatcaccatgggtagatgaacatgtttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaacctttattgccattcagtttagccatttgcgcagcaagttcagcagtagatttacgtttaaacattttatttcctttttaacttaatttaattaacagttggtgctatgacactttacctcatagctggcataatttgcaatactctgggtcttcgagaggtatccaacctgagttgaaatactttaccatcgatttagcagttgtatcagttatatttatattacctttaactcttcgccatccaggagttttaccgtacagattagaggataataataacacataattctcgtaagcaatatgagataatttccaagactctatattagctcgtgatgttttccaaggtctaaaatcgtcacggttcatataattagccaatctcatatgctctctaacttccgggtctttggctggatgagtttcaccactcacaccaaatccaccaccagcatataccagattaaaatagtctggattatctctggcatttacttcaagttggtattttcgttctgcttcaataacatccaagtcatcatcaatttgaattattttaacgctcggtttttgaagcattagcgcattcaaaaatcttttttgtttacatgagctccagtattcctttccggaagagtcatatattattccgttctcaaatgagcaatttaatttactaccgatatagtagtacggtggagtcttatttttgacacggtcttcaaatgtaaaccaatatactatattcatatcaatacttgcaagatttcacagtttcaatgaaaacatttttagctttctgtgaatcaatatttaaaatttttctataagcttttaactttatagaataattgttccaaactaaattatcagtctgttcatcatgtttatcaattatatttaaaaacgaatcaagcaagataaacgtttcaaacgaaattatattcgattgaagtagtttaaaaatataacttgattgaacttttggattatactcaaagatttctttaaaagcagaaacttcaacttttttactaaaataatagatattcctaatatcttcttcaaatttaaatttaacttgctttaagcgaccgatatattcacgataaaatactaatgcatcagcgtcagagatatcaccaatccaagcatcttggttagctacaagattgctaataaaaattaaagttaattcttttaatttatacttttctgatagcttttggaaaaaatacttatcccttcgcttttgataagctgcatcagacacccgcatgcaccaattatacttaataacatcatactttccattcatatgttgttttatcattaagtataatttataaactgatttaccatcaatgtatctttcaccaccagcaggcatgcggagtttaatcatagcagaaaatctaatgtattagttttttcacaacgaacaacagaaggacgtaaaagattttcgtcaatggcttctgactgaattttttcaattatacccgaaggaataaatttagcaaattgagtttcaggaatagagttttcttccaaaaatgctgttgtagcttcaagataactcattccaaattcttctaccattttttcaataataaatccattttcttgacgatcaagaagctttgctatttcatccttttctttcttgattgaaagttctttttctgaaagaccggtctcatcgaccggacgaatatcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggagttcgttcaccttcaactctggtaaaccaaaagtcagaacgtactttaactgaagcaacgttatcctttttgtcacccttaagaattttagtcatacaatcaatttcagcagaaccgcttttaattttaacccatttcttgtgcatcggtgaccattgcttaacatttggatatttgtgaagttgagtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatggctggattcaaaataaccttcccagtcccaagtagattcttctcgtgcttttccacggtttttcttataataataagcgaaatcacggcgccagtatccagatttcgcgttatcaatacacagcacaattttagtgtatccaagcgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccatcttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaatggtgaaactaattatgtaccagttttgcaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtgaatcagaacaccacattctcttttgcagatgaccttatcatcactcctaaaaagctgaatgaaagaactgctacagaaactcgcagaggtgtcgctgaaattgctacgcagcaggaaactaatacaggtactgatgatactacaatcattactcctaaaaagcttcaagctcgccaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatgcaagaattggtttaattgaaattgctacgcaaagtgaagttaatacaggaactgattatactcgtgcagtcactcctaaaactttaaatgaccgtagagcaactgaaagtttaagtggtatagctgaaattgctacacaggttaaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaattggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcagactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagctacgggatttcctaaaagaacatatgaaagtgtcgagcaatttatgtcagcggttggtggaactaacaacgaaattgcgcgattgccaacttcagctgctataagtaaactatctgattataatttaattcctggtgatgttctttatcttaaagcacagttatatgctgatgctgatttacttgatcttggaactgcaaatatatctattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttgggcaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccctatccgaattcgttctggtggcggcactggtaatactcttgtagttggcggctcttccggtggtattagttttagacctgcaggtagtgaaatcactactggacaaattactattacgccagaaggtttgacaacatttaccagggctgtaacggctccatctgtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaattgcaggtcaacgtcctgcagcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggtgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacacgagaactcagcgttatactacccgcatgggtatggtttatactcgttgtctcgctgctgcatgggatgctagtgcacctaagtgggaggaatggaagcaggttggtcatggcacaccagcgactttctatgatggtgaccttaatgattttaaaactcctgggttatataatattttaggcaccgatgccgttattaactgccctacaggtgaaggtttgccgcctgttattgttggtttgctggaagttaaacagcgtgcttctggtggtgctattttccaaaaatttactactgccggaacaggcgcaactactcgcggacgtatttttgagcgtgcatatactggtggtgcgtggggtgcatggaacgaagtatatacatcttactctctgccaattactttgggtatgggtggtattaaagctcaattagcggagttagattggcaaacctttgattttgttcctggtagtatgtttagcgttcctttgaacaaaataaagaacatgccagcaaatatggattgggggacgattgacggaaacttggttatgttttccgttggtcctagcgaacacactggcacagggcgtactgttcaggtttggcgcggtactgtatcccagacaaactaccgttatttcgttgttcgtatcgctggtaatccaggaagtaggactaatacttgtcgccgtgttgttcttgaagacggatcacatacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaatactgtaagtaatatcacctttgccactggtatggctataggtacatccgaatataagatcattgctcagggtgatttatccgctgatggaacagcagatgggttaaaacagtggactttcatgccgtcaggttattttaaatctccagggcgtgtatatgtcggtggtgcgttccttaatacagatggtaatattgccggttcaatctggaagaaatataacaatgcgacaaatttagatgctgccttgaatactcgcgtaggtaaaggcggtgatacgatgacaggtcggttaacaatcaatgcacctaatgattctattgtattatcaacgactgctagtaattctttgcatattcgtggtgacatagacgggactggtaactggtatattggtaagggtggtgctgataattcgctagcattttatagctatgcttctcaggcggcagtacatatcacaaacaatggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgtttcacaggattgttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcggtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcacacgcttggagcagaccataacttcaatggtcaatggttccgagatagatgttttgaggcaggtagtgcacctatagtgtttaatattacaggtgatttagtatcatattctaaagatgttcctttattcttcatgtacggagatacaccaaatgaatatgttcagttaaatatacatggcgtaacgatgtatggacgtggcggtaatggtggtagcaatagtcctggctcagctggaggtcattgtattcaaaacgatattggtgggagactaagaattaataatggtggagctattgctggcggtggcggtggcggtggcggcggatattattctcctttttcacaaatgagattaacctttggcggtggtggtgggcgtccgtttggtgcacctggcggatctattgatatgcaatcaggcgcaactgctggtactatttctgcacctggctcaggatccgtgaatggtatctataatggtggaaacggtggtgaagtaggttccgcgggaggtagatgcaatattcgcggtcaaggatctgaatataatggcggcgctgctggttatgctgtcatagggtctgctccaacgtggcaaaatgttggagcaatatatggtccaagagtataatgtgaataaatacccttaaaaggagggtctatgacagcacctagaatatcattttcgccctctgatattctgtttggtgttctagatcgcttgttcaaagataacgctaccgggaaggttcttgcttcccgagtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccttttcaagattatgactcattcgaaataatcttcaatttcgtaatcatggacataaatcattatagtttttaatacatcatcaatgctttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcgcgtgtatcggtatatcccatctcaacaataaaatgccgtattagatttttatctttatcgttgagagaattaaaataatcggattttgaattaatttccctggccaatttgaatcaccttcagttggcgttttagctcttttatcatctcttcgttcatcgcaatataaagatcgcgtaaagcaagttttagcattccatttactggataactaaatggacatacataatcttttcctacgagctttttagtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaaggtaaatttcgtaagctgaatccataaaggaacttatagctgccatgaaattattgcgaatacctactggagcatctttactttcacgaataatcatgtatttgccagtcttaatctttacaatagttccaagataagccccatggtaccagatgtcccacccctcctgagtgggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcaccagtaatgattaatccatcaccagatttctccaccaggccttttttaatcaataccccaatattactattaactactgcattacctaaatctggatgcacctcacgaacttctgcagctgtaatgaaatctttcttagcaatggtaattaaaatcgcagcagttttttcattcagaatattgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaaattttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctggcatcaatacagatagttaaaacacatgctactatccaacaaataaatgaaataactcctaataattttgcgatattcatattttcctcactggcgtccgaagacgcctttagttttaagattattacgatagaactgcatcacgtgttcgttgtggaaattactcattaatatgcctgcaaaacgaatttaaaattatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtatggaacattgttatttgcaatagtacgtgcaagctgagaccgacgttgacgaatatgacttagaactgcactgaatccttgcttagaacgctgattacctacataaaatcgtgcagacacgcatggattactaaatggacgaccatctaatttactcactaaaaagtaaaatccaggtttagataaaaagtctttatgcggagttcccaaaaaccattcaccgttcttgattgtaccaataacggtagcgcccgcattattcagatcagtagcagtcatatatttcatattaatttcctctaaattattttctactccaaggccgcatgaatacacgcggccattaaattaatcgtcgcagtcgacgctcaattcccaaaactcttctacgatataagtttcagtatcattttcaatacagaaacgttcattactgttatttgctaaagtagcattaactgtcggtttctcgctagtgctcttaagaggtgaaatacgaattaactgatcaccattatctaaacaaaaaatttcaccaacttttacatctttaaagattttcataattcacctcaaggagtataaaatccaaacgcagttgttgaccatcccatccaatatgggaaatttgcgccaatgtaaaacataagaatataaaaccaaccgctcagcaaattcatcattttacaccattccaaattgtttcaaccacggattttaaaccattttgatgaatatcaattccgactactgtcatcaaatagattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactactagtattataactacattccatatagctttaacaatctttttcattttctgttcctccgtagttgatagggtaatagtaccacggaagaacagtcttgtaaacaactttttttaaaaatattcgtaataaatgtgaataccaactactaccgctgaaacctgtgcaacccaccacgcgcaagcaataagtacagaattcaaaattttcataataacctcattacaaaagtaaatgttaaacaaattaatggaatactaattaaccaaacaaaacaccaccatagtgaactcatagttcaatctcagcgattttcatttcattactattaatagccgctttaagactatctgaaagaattacattccagtggtcattcatatgaccattaactaagcgtgtaatttcttcgggagttgaaaaataaggcgtatcagactcccaatgcgataatcctaagcgagtataaatcatgccttcatcatcgctagaatattcaactgacacaaactcatcagttattttatgtttagcgtaataaaatttaaatttcattttactctccaaatccgtatcagttgatagttgtatagtaccacggtccttgtggtatgtaaaccattttgtgaaattttttaaatggaaagataccatccgctgtagttgctttttcttacaaccttacgaaggtcttctctatcaccgatgaacttcggagtgtattggatgacacctggatgaatttctttagtgttgaatataattatacagtcagcgacttgatgatttagaatgggccctagatttattccagaaccatatggatactctccgctgcatcctgttgtcaccgaaatccaacgtgagtcagtttgatgtgtcttaacttctacacgaagcccgcagtatcttggatgcgccaatacatcccatgcatatgtgtacggatcatcgacatcttcttgacctttgttaacatacccgctcagccaatctgctacaaaaaactctgcgtacacagcgatacggcatctttcgataacttctgccttatcctgatttgggttttgttttaaagagtatcttgcagtatcaacaattttgaccttcatttcactagtcaagtcactgttcgatagggtaaatgtcggaatctgaaatagtctctgtaaccccggattcgttttctgcatttaaactttccttttatgtctgaatcactggtattcatataataaatcataatttctcttaaaacaaaagggccgaagcccttattttatttgaattgtgcaattcttttctctagacattcagcataagatttcattgagataaactgcgaaagtaacagttcttgctcaactgcattaactgttagaaactttgcgctttctaaaaatttgctcagtgcattaattttgagcattaattgatcgtattcttcttttactcgtgcttgataacctaacataattttcctcagttaagggccgaagcccttatttaaattgttcagtaacgtcttcaactacttcgtattggcaggtacgcattttagcatcgttgtaatcaatcggaattgatactacatcacgcggatgtactttaacttttacaactcggctagttgaactgccaaagtgacgaatataagatttagaacacacatgcagaccgcgagaacaagtttgtgtatcatcgtcattcacacgagtacgtggcattttaactactttaccagggctgttatcaaaagtatttgaatgacagtcaaagtaattactgcgaactactttccaagcatagaagtaaccgtcttctgtaatttcaatatcgtttgctaccaagaaatcaaagagtcgagataccgctttttggcttgggttttccaacagattttccaagaacggaaaatagaattcaaagttttcgcctttttccatcgagtcaagaatacgatcaaccaaaccagatcgcaattcaatattttgatagaacaagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgtcagatttagcaactggagcaacaactgcatcgctattaactttaactgtaatatcaccgctaatagtaactttagagcgtttagcttcttcagcatttttcaaaacacgacgaattgtgtcaaccgatacaccttgccaatcagccaattcctgttgggtgtaattgccacttgaatacaatttaacaatttcagcttgttcgtttttggtcaggcatttaatattgtacataattttccttattaggccgcaagggccttcatagttttagcgatttgggaaacttcatcatcactcaaagagttacgataaccgatgaagtcggaaacaatacggaatttcttggtaaactcagcaaccattttatcactattttttgaagcattacgtgataattcatcaaagagattagttactgtccagatgtcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgttcgttgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatggctttgcttaatgcgtttcagtcgagggtcaagatttacttcatacacaactcctgcattgcataacttactatcaggttcaaacatgctttgcatcttcttatatgacagatttttagtcgtaaatttgactgaattactaatcatataatctcgagcagaataccccatcttcatcaattcacgatatgtatgacggggagatgtggattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattagtaaaaaacccgagcagagaaggataaatgcttcctagaccatcatggtcagcatcagtcataatagcaatattatgataattcaagttttcagctttttcaccgagaactaatccagtgattgcgcaaatatcaaacaattctttgtttttaagcatatcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcatcagaattgcttcattattcaaaatagcacgtgaaatctttttagcgtcaagttgaatatgactacgaatttcgccaaatggagaagtcaaacgctctttagtttgagaatcaaatcgcatgtttttcatatcacgaacaaacataacgatagtcaaacattctttgacacgcgctttagttacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagagcaattttcttgttcttgaacgatagcatgctcatcatattggcgtgcatatttcttaaaattgccctgaacctttttaccattaaaggtaaattgaatatcaggataaactactgcaagtgtctggagacggtccagtgtaatgtcaagataaacctgagacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccaccggtgacacgttctttatcatcaccaaagttaccacctgcttttggaatagtccatgcagcaacaggaccaggaatttcttcaccggtaggtgttttgaccatcgcttgtggaataccgcgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcggaagagccaatgtacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgccgcgatagaacgattaatatatttcataattttcacttaaatttaatggcttgaagaagactaataattctcaagcgacttccttcatctttaactgtaaaagaaagagggtcaccagatttcatagtgatagtgcattcaaaagcaaaaccttcgggaacttcttcgaagaagtcaaattcttcatcataaattagaacattactctgaaaactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttaatagcttgaccgagtttccacttaaagtctacacctacatgcgaagtatcaatcgtttcaattcctttagcgggaacagctttcaaaaacgcagattcaagaaatttcgcgcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttcgaagctaattcttcacgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcaggatgtctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagttcattctcagaaacaccattaagacgttgaatatcacgaatgagatcgactaaaattggaaaatcaaacgacattccacggcaccagccttgagatttccaaggatcgatattatgtgcattgatgtaatcattaaatttcgcaataccgtcgatagtgcttacatcttcatcggacggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttccttgctaaatcgcgaatttgacctacagtataatcttgaatataaactttattaataggttcatcaataaattttgccatagattcaatatctttttgtatttcttcaagactgtatactatctttaaagctttttcgcgaatagtaatattttcaggaccctgattttcttcaatgacagctttaacatttgtcataagagatttaaactggtaccaactcaattcaatcattaataatcgccttataaagatagctaatttcgcctaaaatataatcattgattgtaacagttttcacttcaccacaaaagaattctaacgcaattaaatctcgttcaatttcttctaattgaagcctcaacttactagattctatttttacagtttcacgatttttgctataagcaatttcataaatttcgcttactttatcttgaagaagataaaactgatctttagttatttccacgaatagcttcctcaaatttaatcatacataaaacacatcataacgaccacgggtaacaccaacataaagaagttgttgagccaattcagcatctgcataatgaatacaaggcgtataaatgaaagcacggtctacagacatgccctgtgctttatggaatgttgatgcaggaagtgctttcactttactaaactgtgatttagcatcccaaaaatcactccatggagcttttccgcctttgttccaatttttataagtttctgccgttttacctaaaaataggttaaacttatacagttcttcatcagatgaaattattttaatcttttcacgataatattcatcatcgccataagtttctactgttaaatcccaatgacgaattaagtattctccaggaacaccacgagctttaacaaacgtcgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagtgattttacgattgaaaaataatttaccataaaatcgcgtaaagcggtatcacctgtaaatccacgtactccatgcccgtcaacaattttatcataaatccacttaccgttacgaacgtcagtagctacatcaataataggagcattactgcgtttaacttcagtgagttcacactgataaaaatctttgtgtgtaaagaatggactgatataagcagtgttttctcctgggtcaacaggtctaatctgcttattatcacctattccaattatagtacaccacggcgggatagttgaaagcagaattttaaatagctttctatcatacattgatacttcgtcgcagattaatactctgcatttagctaaatccggtacttctttttgttcaaaaagaacgttttcttcatatgttactgggttaattttaagaatgctatgaatagtacttgcttctttccctgatagttttgaaagaatctttttagctgcatgagtaggagctgctaaaataataccagtttcacccgtagatattaaagcttcaatgatgaacttagtaagagtagtcttaccggtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaatttacgtggagtctcaactaatcttggaattcctttacctaaagctagtcgatactgctctttaagagtggtaaatactttatcagcaatcttccattcaaaaaatacagcaggacgatgttcatcaagcggaactggcgccgtaaatccgtctttgtctcggtaaactatcgcatatacataaaccatattatcctcggataagtttaaaaattgaacaatttagcgggtatcctcttttcagtttaagtttatcaataaaagacaaattttgataccgctctacaccttgaataattttatcacacatatcatattgcatttctgcttctgacagctttttcacaattttccaatccgagcctttaagaagaacgttcaatttaacaacttcagcgccttctgctatgcgagaaccatcaatacgtgctttaagtgctataatccttagcttaatgtcagaggtctgttttgatttagaaagctgagaaatgtgttcaattcggttttcacgttttttctgtatagctttaatttgattataagtctttttgattttagcccatttcttttcatctaaatttagtttatgaacttttttcgcagatgaacgaccaattcgcaaagcaaataaatcacgcttttcaatcaactcttctaaagtataatcagaacgaaatgtattatactttttctttactgcaataacattccctttaatgtatccaacgttattatcaaaacgttctaatgataatttctctccttcaatacgattatcaaaaggttctcccgagtaagcacaaactttttgatctaaaatgttcttaatgtaattgaagtctaagttaaaatctttagaacgtctttttgcagatgcctgagtatgctctagacgacgtttaattttacgaatttggttattagacagcttcatatttttctcacatcttacggacggttaactacttatactataacatttttaccttaacttgtaaacaactttatgaaaaatgctttaaaactttcatggtataatgaatctaagtccttccattatagattaaatccttcaaaatcaagagtatagatagtgtatgttgaatactttttatactcgtatctatccgcaattctaaatacacttccagctggtatcattacttcttgttcatctgaaactaattccatattacgatagcgatggctatccggaaacttaaagtttggattgtattctttacagcgtagagcttttatagcatactcctggaaattaaacaccataggagctttgaattcaaaaataacttgtgtgttgtattctaatccagaagcaaaatgtagagctatatttttatcatatgaagctgatactactttatcaaatgtaataatatcaattccttgatttaacacctgtttagtctcaactggaacacctctccaaagaggtttatcgtttggaaccaaacgagatttgactatttcatttaaccaagaatgatcgtctggtttattagtaatacaatgaattaaaagttcaatttcagataaattaaatccttcagaaagtaattcttcacgaatagaagcacgcaccgatgcatccattgatttgattttaaaatcttttaattgcattgctgaatatttcattcaactacctcaatatcatacactttaaatgttccaaatgaatcgtgtaatttttcttttgaaatagaagttattctatactttccaattggaatcatccattcttgttcacgcacaatcatcattaagttatcagtacgctctgaatctaatccatcagtatcttcatatgtatacttaaattcagtattaggagaagaaagtataatatcgctgatatggtcagaataattaaaagctttatcagtttttaagcgaaatattatttcagtgaaatactcaacataagaaaaaccacatgctgtgtgcaaactagtagtaaatgaatctactctgttcgttgaaaacacttctccgacttgtaaatctttaatgagttcttttgtcgattttgatataccacgatatagctgataaggcgatttagttaaatgctttttaacgattttattcaactgccgatgaagagcttcattctttttggcttccatacactgccaaagaactgactgttcaaagtcagtaaatttttcacagacctttttgtacatatcatattgaaaatcaacactttcagcttttatagataactgttcaacatctgcgagattaataatcatgatagcctccatatacttcagaagctatcatatcattgttaggaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaataacgattagcttcaataatctttctttcttcttcagatattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgtgatttccttttgcctactaatgggccgtcaggaattttgttttcctggatatatttctcattttcttccatcattttactgccaattttaagaagcaaatccagtgcttcatttgctttagccttggcctcttctagcgtcatatctctgttcatgatttatcaccatagatatctctcatcaatttaagcgctgagcgttctaatttcttttctttctcagcactaatcattgatttcatccattcttctgattcgttctgcatttctttatttgcttgttcaacccaaccatcatcaatatacatcgaatttggtctattgaaccattcaagcatcttcttcagagctttcatttgttttacctaaaacaacagtaggagcatcatcaaattcatgaattttgagcaaatttggatgtaaactattccatacagaagaaataaagtatgataaagcatcttcactcgcaattataaatttatttcctttatctattttccaactatatactgaatcgtacgaataaaaagataaaggtttatcattatattgttctgcgctaacattaatgtattctgatttagtaaatgcttcaattgctctaaacggaatatttggtacagtttcaataataccaatctttttaagttttatttcagcatcttctggaactggcattgaaacgaaattttctacgagatacattgggtcacaataacccttatcaatcattactgctacagtaattggaacatctttagcaaatgacaaactattactgctaatatacatttcaaacaaaatcgcttccataattttcctcaatcacaagatgtagatgaacaactagaatcacaagaacttccacatgaatcgcccgtccacacatgaacaggaacattagtatcatatgaatcagaactagactgtgtattctgcgtattagatgatgtaggtgttgaccaacgccaagggtttttataatattcttgggcttcttcataagtcatagtaactgcttctactgttccatctcccatataaacatactcaactacagttaaaggaaggtagtcatttgaaataggaactacaccttctccaggagtcgtagagaaaaaatccgtaaagaaacttttaaaccaattaaagataaacattacaaaaagcctctttgaaattcgactctttgaaatccaccccaatcagtgtatcgcatttcagcattgaactcgactgaaccatctgcatgcatcatgaatgaatgcgtgacgatatcacaatcccagcttttcataccccatttatcagagatagctttatcaagaaccttctggaggtcttcatttggtttaatccagcgatttaacatagtgctctcctctataagataattttattataccatactcattttggaaagtaaaccggtaaaatgaaaaaaggactcccgaaggagtccttgaatttattcaccagttactttccacaaatcttcgtttgcagtaatccattcagtacgttgattttcttcatatactgtagaatatgctgctttttctgaagggaatatctgataatgagcgccagaaattttgtgaacgtcagaataaagagggaaagctacagaaatttcctttccttcaattttcttatttccatctaatttttgctcaaatgttttaatattaacataaccgcgagtactagccatgtaattctcctttatttaaattacatgactatttataataaattcttgcggaacgttaaaatacccaattttagttaatataacaacatcaccgttaataattaccggagaataatcggctggagcattaaacttccaatgagctctaatattatatccatcagaaccaaatgctcaactagccggtctcccggctttttgccatgcataaaaatcaaatttcattttgaatgctctataattaattttaaggcttcttcatgcaccttacctaattgtatatgtccagttttaattgtgtaagctttgtggagctgattagataggagctcgtatgtgagctccttgtcataatttttaaatagctggtcaatacgtttcttgtgggctttcttaagttgacgtttatttaaacgagccattaataacctcggtcttgacgagcgaagttttcagcatttttcagataataaagtttaaagatttcttcagccgtaagaccgagaccttgaaacatgttcagaacaaaatggagaatatcaatcatttcgaatttgatttctaactggtcctgtggagacaaatcagtaatcagagtttcacgacgttcaccatgctgagctttccacggcttccatacagcagatgcatctttttcgccattgctcataccaccaagagaagtcagaagttcgcggaattcatcatcaatataatctttctgattacgcagccaatcaacaacttcacctgcggtagccaaatcatcaggatgacgattatattcaggtttatctttagctaaacgaatctgcagagatttctgcatgtcaagcattacctgtagcgggtctttttcatcaccgagaatatcccaatattcattttgagctttatcagcgccttcaatcagttgactacattcgttaaagtaagccattatttttcctttcaattcattaataagttaaataattatatcatttgagtatgtaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttataagatatggagggtccacatatacaaaatcgccgtctagaattttgacatctttaaaatgcaatgaactaaagattattttatcacaattttgtttaaagtgattaaagcgtttttcactatttttgtttatagttctttttccaaacggagtagtaaaatttcctttatcgtttatacgaatcatattactaaacccgtgaaaatgaagaacataaagtaaaagaggatctctagttttattataatcttcacgtaatttcaaaaactcttcttttgatgtttttgatagtttgtattgctttattacttttaaaacgtcatcccatgatacattaataagacgcttatacatttcaataattggttcttgaatatcattggccaatacaggaccattgacgttcaaagacactgataaacctccacaaaataaatccacgaatctgtcatattttggaaaatgaggcttaagttcaggtaataatgactgtttattacctgtatacgcgatagctcctagcattatattctctcatttattgcagcaaaaaaacgaattatataattcttcatcatatgtatttgatagtaatactaacacgttttgtgatttagcatattcattaaaccttgcttggatggttggattatcagtaaatgattctctttttgtccatttattacgtggataatatccgcatggcaaaaaatctaatatcatcaatgacacagggttttcagtttttgtgtattcttttaatttctctttatcttctaaatatattccaaccgaatcaatagctgtacctccaccaacttggtgtttaatttcaattatatgctttttaccgttgcgagaaataacaatatcaaatcttctagtacgcttcttagttataaaattagaacaaaacaaattatttgatttttcagtatcatcggttaaaaccattttttcttgataactaactgaacaatcagtgaaatattcttttactttattaagtatgaaattttcaactacggcagatattttatatgaatctccgtttaaagccatttcatgcacaattttattaatcattatatcatcctcagcaatttattttataataccataacaagctgagaaagtaaacaaatttatgaaatttgtgataaatattaatttaaaggaggacatatggcacaaaaattaatggcacttgttaatgccatcaaaggtaataagaaacgtatagcttttactatttctgctatggtaggaattttactctggaactttattttatcaccaattgcaattgcgcatggtgttaatattccagtagttactcttgatacattcgtagatctagcatttgctttagttgggttaatttaaatcttggcatatttagataaccgcattttagccattaacccctgggcaatattatttttcatatattccataatttgttcaggggttgcaccttcctttctaatcatatcattaacatcttttgatttccagggagatttatcccaaaacataaccctttctcctgcatcaactaatttagtcattcgcttgatagtgtcagggtgacgaggttcattatctaaaacccacactcgtctatctttaaatggaacaacttctaggtctaattgaccacccgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtggagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaagattccaccgacatactctgtgctgcgtttaaagtctacacgccaacgaaatgaaaaatattcaggctctttatgagctctgctcataggacacaacgagtaactagaataagagatgtcaaatcctacgccttcaatatgagccaaagtatcatgattaaaccaattataatcgtacgccaaatccattagattataatatgtaaaaggcaccggattaacgtcattaatcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttattattaaagtttttatcgcaatacagaacataattatactgcattacaccaccagatttaagttgtttttgcactttagctttcatttcaggacgatcgcgctcaacgatattcataatatccgcttcaatttgagtttcaacttcagtctgatctgcagtcatagaccattcgcacaaatctttgtcataacccgccatagcaggctgagcagcgcaagaagataaagcaaaaattgcagcaaagataaattttttcatgataatctcctcagtagtttatgtttatatagtatctcaatttccaataaaagtaaacagttattttaaaacttctgcataatcacatgttacaaactgtttctctaacttggcgattttacgaaagtatcttttgcattgacgaatctgtcgctttgtagggcgcacagcaaacttaataaattccactcgaccaaatggagggctttcttctgccggaatatctaatactaattcccacgtatctgcaataagtgctttgaattgagtatttttcctgacattatacggagtaggtttaaataaaacgatatgcatattatcctcggcaatccacttcacataccttcttgtcatcaatgaaagctttaactagtgctttattaacttcagcatattgagtagtagcccattgaacgtcatctttcatcattgtgatctctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacctagatagtcgacaataatgattgttggaacaaaattcttcttgagctttaattcgtttaaaagcgatcgaaatgtattagcatctgctccaccagtaggatactgtttaactattaaacgaccgagagtagatttctcgcgccatttttccatttttcctttatactcagcgtaagaaatatgcccgtcatcaatgtcatcaagagaaacatcaagcatattagcatcaatacgtttagcacagacttcttctgccatttccatggagatataaagaacgttatgaccaagctgtaaataatccgctgctaatgaacaaagtcctaatgatttaccaacgttaacaccagccattaaaacgttcagtgttcctgtctcagctccgcctttagtaattttgtttagaattctgagtttaaatggaactttacgagctttattcatataagatagccagcgtgcttcgtagtcatccatccaatcatgaccaacgtagctatcaaatgaaattgataatgcttgacgcatgatatcaggaatagcacctacatctggcattttcttatttcgtttttccggaggaagctcagcattagtttgaatttcgattattttagacgtagcattaaacatcgccctttgctgaacatatttttctgtttcttttactaaccaactgtggtcttctggagaatcggctagttttgaaataagtgtttttacaccagaatattctgtttcagtaaatgaactattttctaatgcaacatttaacgcattaatagatggaacgctatggtactcattaacatgagatttaattaatttgaacgtatttttagctggaccactttcaaaatattctgaatccatatatggccaaacttttgaaaaataagcttgatcaaatatgagatgagaaagaataatttctaccacacttactccttaaaagaatttaaactttttctttgaccttttattaaatgcatcttgtagttgcattgtaatacatttttctacatgaggagctaactcagcttttctttcttggtcaagaacagcaaagtccattacgacttttccatcaacccaatctaattttgtcacatacacaatgtgtgtagaaccatcttctagtttaatgacaatctcctggataacattttccatggcagatttaattatcttaagagattcattaaaaagacgttcttttctttcttcttccccctccgaagagggggattcatcgataatttctagatctaagtctaaatcatctttattcattaaattcttccatatcacttaactgttcgaggtcagtttctaaatcagcagctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttagtatcttttgcacgccaagatttttcttcgcgaatcatctcgccggtttcttcgtcaagaaattcacgagcataccaaccattcttaggttttactacaaatcctaattctagagccatatctaacaatccagaataaggatcgataccaccgtcaaatttaacatcaataaagaatttacttttttctttaacggtacgagatttttctatatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatgtttttaatactaaaataaggagtaacaatacggaataatgacttcagtgatttagcacgagtcatatctgccacagatttttcattcaaggcatcttccgtttctttcttagaagccatattaccaattgagtcgatgaatacaataactttttcaccgcgctcaatagcttcaagctgattcaccatatcaattttcagctgttcaactgactgaattggtgtatgaattactcgttccgggtcaactcccatggatcgcaaataagctggagtaataccaaattcgctatcatagaatagacataccgcgtcaggatatttgttcaaatacgccgcaaccatagtcaaagacatatttgatttaaagtgtttagaaggacctgcaaaaatggttaaaccagactgcataccaccatcaatcgcaccagaaatagcgatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgtgaaacgcacatgcgaagaacctttaatggctcgtcttcttcacccaacgattttcgtttttcaatattagaagttttccaacgagcttgctctggaaactctctattgatttgctcaagcgctctattatgtttagaattactacgaattgaactgcacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccaaggtcataccatgtattcgtgaatccatatgaattttcacgataattaccccaagatgaagtaattttaaaaattggtagacgagcatggccatgataatatccgcaatccatggcatcctcaacatattgaatcaattcatagaactgttcacgagttaattgattaattttatctacacatcggcgatcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcgtgttcacgcactacaatatggggttcataatcagtcggaaacatatcaagggcagaaactgcccctacgcgctgatagcttggaattacgaattgaatcatttccactcaccgttataatcttttttcgcaatatgagtttcgccagttttcaaccaatgatcaaccaagtaaaaatgacgagaatatacatgaagacttccgacattccatataatggaacctgctttatactgacgagttgaatcacctgcattcaaatcagatactaatttatctagtacgtatttttgccacgcataatcattacggaatccgaagaccacgtcatttgaacgcatgcttactactgcattgactttcttatcacgaatcaagtactgtactgtattcgtacacatgaaatctgacataccatctttacggtagtcaaactgcatagatgggcgagtataaatcatgataccacgccgagaatcaggattttgaccaagttcaaataaacacatatcatactgagcatagttatcttctgaccaaatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaaccccaacctaaaataatagttggaatcataagaggaaccgttacactatagtatatacttattataatcatcaagattaaaagcaatgctgttataattttgcttttcattccttctctctgatgataattacctgatttggctgcgcagactttttagtttcacccgcaattgaccaaataaatgtaataaaccaaccaataattgaccagttaaacagtaaagatgtgaaaaagattcctactgtcgattttgacccacgcatcaaagcaataaaccatggaagcatgtatataataatagccaacacacctgaaactaaaaccataaaaattgaacctgctactaaagtttccatattttcctcacttagtcaaattttttacacatgaattataagaattcactacatactccatcggagcatttttaccagtacgccattggtaattattggcccaattagcccaaagctcggcgcagtagttttcaattttttcttcgcgtgtaattacatccgaattacgatatgcttgagcagattcatctggacgaatagcttcgtcaaaattcgcctgcatttgttcgactgtttgctttggagcttctttataacacttgacattaggattataaaatttgcttgaacagtttacaatttttcctgcatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaattttttagggaattctaaatgtccagaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtggtcaatccaagatagtacgtcagaacgaatttcttttggaagttctgtacccgatggccaagcaatgcacttgtcaccaaatggatttccttcacgtaatggaagaaccattactttatttccatccaaaattggagctacacccagaccactaacagctcgacgataagttagcacaccgcgaatatggaacgggcatttaaatcctggccaacctttatcatcatatttcgctatatcgttcgcagtttttacttcagcaataactttatagtcgagttgacgatattctttctcgaagttcttgtaatattcttggacagactcttcaccttcctgaagaatacgacgaatactttcttcgagagcttcttgtactgcttttggtgttgaactctgctgagtttccatacccatgatttttagatgcggttcagcaaatcgtttatcttccatatcataaacgttcagagcataacgctttttcgctttccaaaatccaccaataccctttgaaccaagtggagggcaagaaatagcttcacggtccatatgcatcagatgctcgcggttattcatataatcacataactcacgatatgcaacatcaatcataggttccatctttttcttaccgaactgattcataaattcaaccaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtattagcaagtgtagcagctttttcacattcctcaatcagactattgagaacagattcagtataattcgacagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgaccacgaatagtctcaggactaatgttaacctgacgaataatgctcggatacagagacgtcaagtcaaaactcataatatatcgacgagcaattggtttaggttcaaatacgaatgcacccggaaaactctgtttaacgtgcgaaccctgttgaggaataaccttatgttcacctttcaatgagttaaaaataatagcatcccaagttttaataggactcattacaccagaaaaaggcattttagcataataagacatacttaaaactagatcgataaacccgcgaattttatcaattgcttgaactgattctacgtcaatgatgttataactaatgtatcgttgatgattagtctcacgaagtttattaataggaccatcatacggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccagtaaaaatagcaggtcgtttctgttcccagagattgatatattccatgagcatatcacgctcattatcaaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcataatgagtgatagcatcaatttcatattcagctttcattggatcaggaaatttatcaccagtaacctcaatgtcacagttagctacacgaacaaattttcggtcataaacaatttctgaaccatacgtatcactgatataagcgagtttaaaatcgttcataccgagagcttcgagaccgatgtcttccattcgcttcatccaatctcgagcatctttcattgatggaaatttttgaggagcgcaatttttaccatagatgtctttgtactttgactcttccttacaatgcctaaacatagtcggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaattaaggggccgaagccccttgcttaaattagtactatttgtcgggtgaaaattgtcaatccatctgcattaattgacttaacgactgcagtaaagtgtttttgttctgggtgaactaatttttgaaattctacctgaaattttagttgaaggttttctggtaaatcgaaaagtgtttctgttgcagaaagattatatttttctttaagagacgccatgtattcttgcggagttatagcagtcatattaattaccaatcgtatatttaggaacgagtttccattcatgtttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacttggcgaccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaagtaacttaataatcaatacttcagtagaatcttcgaccagttttgcccatttaccatatcttttaccccgaggaacagcagccatcagataattaaaatgggcttcatcgcttaaacctgatccaattaaattcatcgcatatacagctggcatgcattcaggaaattgtgataatgcattctcaaccatgtattttgaataatctttttgagcaatagagcatttagttttattattaatagctccaattatttcaaaaaactcattttcagctttttctttaaaagaatcagcagcggattggacagctgtccaatctttagaataccaagcaacttgatgctcgtttaattgaatatcatcttcaaataagctcatatcacttccactgcatttcacatgctaattgaatgaaaagatatgctaaatgtaattccgtattagccgcaattccgtgatactggttattttcaccaacaatttcatacatacgaataatactttgtggagttacgcgtgtatagatttcttcggcaagtttacctacgaaccacgaataatcagctgcatattttggtgctaaagctctgagctgtttaacatctttatttttgagagattcaagaacatcatcaatagcaccacgatcgttagtaaccagtgataaaataccagcatccaaaacacctttagacgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaatgtaataactcggcagcgtgactgaagcggtttaataataccatcaatattgttagcagtaataataatactacagtttgaactataagcttccataaatgaacgaagatgtcgctgagactctgctagccctgaacggtcaaattcatcaataacgattactttttgacgaccatcaaatgaagctgcactggcaaaattagtcaaaggaccgcgaacgaaatcaattttacagtctgatccatttacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcagagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgaacgagcatcagcaattttaatatttccatcttctgactgggaaatttctgcgtcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccggagttaatagtagcgaaatttttaagcagagcagtagtatctttagacagtttcatgtaatttccttcaattcaaatgagatttaattttataactaattaaataaagcaattaacgattaaaatcagctgcgattgtttcggcaacaatttgagcagcaacaattagacgttcatctgcattaccgcaatattcatcttcaaggcgttcaccgcatgaagtcataataaatttagcaccggcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtgaatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccagttgaatattccatgtttttcctccatagagattatactctaataaattaaagcataatctcttataaattaaaccattacagtaaatcgaccgactttcttcatttgaagatgctgaccatattcttgcgggtcatggtctttatgcgaaattataaaaacattagtgtttttcattgaatttataatattagctacacctttaataccttcggcatcaaatgacccatcaaacacttcatcgagtattaacgtactaatactaacaccagatacaatagaagcaatatcacgccaagtaaataaaagagcaatatcaattcgtgctttttcaccttcactaaatgaagcataactaaaatcttcacgaccacgggatttaattatctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagctgctttaacttttttagctttatctaccgtcgtgattagagattgctttttattgcgaatatcatttgccaacgactgctgagttttaatattatctcggtattcatcaacaagaacttttaaattatcacggtgtgttgaaagctgttcaaacgaatgcgtacattcagaaactttatctttaattttagaaacaactttatcaccggaacttaattgtgacaagcaggttggacataatccaccttcgtgatacatattaatgactttattatacgagtcaatttttgatttaattaaaactgcttcttgaccgattttattaaatgcatcagtcgggtcttcatccaaaacaatattaactaatctttcgttagcttcttctatttccgattttagcattctagcttcttttgccaaatcatcatacatattttgtagacgtgtaaggttgtcacccgttaattttttctggcgttcaacgttatcattatatattttaatttgttggataatactatcttttttaacatcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgtttggtttttgtcctcttttgatatagtactttttctcatcatattccatccacagttcaactaaaagttctttcttatttgtgctgtttattaattggcctttctttacatcacgaaatggcttgccaaaaagcccaaatgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgcaatgatttaggtgtgtcattatctaaaatgttgaagttaaaagatacagcccagtcagtgcagaccgtgacctttttaatacaattatcttcaacctctagcggttcaaaccaatattcaataatttctttatgcccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgttagatttttgtctacttcagttactataacacgtactgatagatttgtaaaatctttatagtcaatttttcctttaaatggataatgaattctacgatgccaggtagtgttgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttaatatgttcaagaatttcaccagtattttcttcgcacatccaaggaattaaatcaatcaaacatccgtcaaaatctactgtagtaggcttatcatatactttaacattaggatatttagccaaaagctcagtagaagcatttggatgcattacatttttgtagtgaagatcgtgatttcctacaatagtatgtaatgtgattccagcaccatcaagtatttgaactatttcacgggcaaactccatagttttatgcgtgatcgcttttcgcacatcaaaaatatcaccgtattgaatccataccgtaattccatttttcttagaatattctatcgcttgcttaattccatcaatttgaataccgcgaatccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcatatgctttttctcgctcacggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaaaccggatttactcatgcgttcaagcatttcgctatttacataacggtcaagaatttgcgttggcaaattaggagcaattttaatttggtctacttgatgaagacgataatactcgtatggaattcccttttctttaataggaatgaacgctggagaacgttccagaccttccataatagtacttagtcctgcaggtttaagatgtttttcatgaaaatcaaacatctggtaaaaacctttccatgtagtagtacgaccaatccaacggttgatattcatgttaatttcagaaacatctttccagtaggttgatcgaaccttcgcaatatccataggaggctgaaagttatatacggtcggtgcttcttcaatatcatcaaacagagaaacggtttctggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccattcttaataaaccaatcacgttgctcaagagaaaatttagttacaccacaaccttcaagacctcgagccataaaaatacatactttcatttaatatcctctttattttggtttattttaccaaaaaatttataaagcaatataggagccgaagctcctatccacataatacgccatacagaggctcgttagaacttttaaattttatgcgcttatattttatagttccttctgctttagctttatcatgagacgctttaaagagtctcatcatttcctctttagaggaacgaattttattataatctatttcagaagtctgggtgttcatctttcataactgccaccattttttgacttgataagaatcaacccacactttcatattagggtctgctcttacaataggaggattaacttctttaattgaactatcatggtattctttttcagaaattttcacacaaagatgaccattcagagattcagtaaatcctgcattaattttaagacgcttgaattttacgtgtgtaagcatcaatcatatcctcaatctgcgatctagtagtcttccaaagaatactaatgagttcatcgttatatggctgttttagaatatcccgacttttcttgatagcatattcgtattgagcaaaattattattttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctgggtcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacgaatgcattaaaacaagcttgagttatatatgcatgtgggtttttatatttcgtttcatcaaaattatgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacaatatgcttggaatactttctccatcatctttttaaattcatgaatatctatataatgactagttaaatcagcatgatataaaaagtctaaaaacttttcatgtgtgctaacgtattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagcagcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccagcaagacgcaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcatctgatgaagctctttttcccatttatccaaaatttgaggagttacaatatcgcctttttctagcaaagaaactactttatcatatgcgtaagaattaatgacgtttttaatctaaatagtcatacattatcctcaattacgttaaaattttattatccaaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaagtattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggtaattcatatgttaataataccacggtttgaacttgttgtaaacaactttgtgaaaaatattttagggaatgataagaaaggaacgatagcttagaatggtaatatacagaatgtaagaaagaaaggcccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccattatttgtaagaactttatagaaagtaaaaggagcattgagctcctttagaagttttgtaactgattgacatccaggacaacgaccaacttcatctggaattccatagacttcaatcttattttgtttcacaactattccttactaagagcagcattcaacttattagtaattttatccaaacgctcattaaactcactagaagataagcccttttctggagaaatcaaactaattacgaaaaatataacaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatataattcaatttaatcatgtttccacaccccatcggtatttgaccaaagccgctgattatctgatcctcgccacagctttttagtcggaagatttttctcatacttcccatcaataataacatcaacatatttaagcatttctagttgtttaatatcttcaaatttatatcctgtccacaaccaaatgcttttattgggataaagattttttactgtttgaacaatgcaatgaataacatctcgattatcaggatagagagggtcacctccggttatagtcaatccttctatataatcattattcaaacattcaattaattgctctagtgtttcaccagtgaatggaataccatttctagcattccatgttgatttattataacacccttcacatttatgcaaacaacctgtaacgaaaagaacgaccctacaaccagggccattcacaaaatcgcaaggataaaatctatcataattcattgatgcttaaccctatgcatgatttctttatttttaccgagattaaatccgcgttcgttcggatttcccaaataaccacatgttcttcttattgtgttcatctttttaggatcagtttctccacaaatagaacaaacaaatccgttttcagtaggagtcatttcatgggtgcttccgcatgtaaaacacttatctactggcatattaacaccaaaataatctaaatgctgtgcagcataatcccacacggcctcaagaccttttaagttatttttcatatcaggaagttcaacataagaaatgtgaccacctgtcgcaatgaaatgatatggcgcttcacgagaaatcttttcaaacggagtaatattttcttctactgaaacatggaaactgttagtataccagcctttatcagtaacatcctttacacttccatatttttcggtatcaagtttacagaagcgataacataagttttcagcaggagtagaatacaaactaaaagcaaatccggttctttcagtccattgtttaagatgagtattcattttagttaaaatttcttgtccaatatcacgaccgacaagaatattcaattcgtgaataccaatgtatcctagagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatctaatgcgatacgaggaagattcagtgttacaacaccaagattattacgtccatcaagaatttcattgccagtcgaatctttccatacgctcaagaaactacggcaacccatcggagaaacaggaacagatgaaccagtgatagctttattgttcttagctgaaataatatcaggatacatccttttgcttgcgcactctagagcaagctgtttaatatcatagttcggatcatctttataaagattaacaccttcttcaacaaacataacaagcttagggaaaataggagttatcccatcacgaccaagacctttaatacgatttttcagaattgctttctgaatcattcgttcagtccagtcagttcccgtaccaaatgtaattgttacaaaaggcgtttgtccgtttgaactaaagagagtgtttacttcatattcataagcttgaaatgcatcgtatacgtctttttctgttttagattgagcataattcaacgcatcagcgatttgccatttttctgcatcctcaatatgttttgcataggtgcgtttaacataaggagaaagtactttatctacattcgcaaaagtcgttccgccgtattgatgggaagcaacttgcgcagtaatttgcgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttagtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgcccctttaatccagaacgattaaatttatgcttcatttgaccttctgcggcattgcagagattacaaagcaatccacgtacctttcctgcttttggtccatttaattcatggtcatgatcaagatgattagcttgaacatcaggatttagttctcgttggcaaattaaacatttaccgttttgtgcatcataaaatttctgtttttcttctttatataatttgccagtcaataacataataaacccttaccttaaatagataagggtatttattattttcaagtattgtaaaacatttgatgcaatcgcttatattgccgaatcttttggtcagaaaaagaaatttgagtttcaagccattcaatatattctgccgcagcttgcatcaaatttccttcatagccatcgttattttcttgtgcagctaatttagctaatgcatatgaaatacgttcaccttgaaaaccggctttaggcttctgaacaacttgattagttcgctctacaacttcttcaatttcgccattttctactgattcagtattccacaagcaccaatacgtaattggcttatcgtagatgttaataatctttccatcagaaagttcaatttcaataattccagtatcaggctctatatcatcttcacattcttttgcaagttcacgaactttaaagacagtacctgcactaagttccggccagtaattacacagccctgtatcagcacgattaattctaaaccacttatctactgtaatcatgtcccatctccatatcaattaagtcatttatcgttggttcattatatattgtttcttcatcagtgtaaaccggttcttccggctctggctctacagtttcccatctagccgcccaccaaggttttatagcgtaatccattctcgtactgtctgagttactacacgttcatggggctcgactagttcaacagtcggaactgcataataccagtcagaatgataagaacctgaccgagattcatttacagccacatgtacattatgttttggactaaagtaaacacactgacgatattgacatttaccatcttgcacccagtcttccatttcgacaggtttaagataatcggaaaaatcgaaatcatagttttccgaaaatgcatcatggtcttcaatgatttcgctcagaactgcatcaacatctaatttattttcaatagtcatttttcaccaattaatttcgcaatttattaagttcttcataatcaatccaggattctaatcctgatggcaaatcagattcaatttcccaaagaagctcttcaattttctgaagacgatctagttcttcggctggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctgaggcattgtcaagccgatttgagtatcacgacctagtttagtcagaagctcagcgattttctcatcatcaaaaacacctttttccggcataatgttgataaattcaaacggctgtttcttcacagtcaaaagacgttttgcattatcgcaatacacgcatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgattggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcaatcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatacatttccactacgtccataatttttaacatcatgcggagtttataagacaacgaacgaatagttttgttgtgcttattaatttctttagctgtcatggtgccaagattacgtgagtaataataaggaacctggatattaattaatactgatgaaccacctggcttgtgtgttacttcatcagcaataacccagtccttaacatgaactgtatttgtacggttatcgcccgcggtaaatagtttgcgagcatgcttaaaaagcatattcacttggtcattgaattgacaagcaaatttatcagcaaatttagtttcaggaatggtagaaaaccaatcagccaaatgagtctttttaacatcattaacaatagtaaattcaaccaaatcggttatagatgtctcagatttaatgaagctcggcttcataaagtttttaatgttctcatgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgtcctatctgataattacgatgtttagtaataagactgtcaaaataatcaatataatgtttacgagttttcatgttcttctcacttggttaatggtttatactccaagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgcttgaagaaacaatacttgcatcaatattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcgttgttcagtttagaacgttgcttcgtaagatttttgactttttcttgagctttttctagcatcttttcagcttctaacacttcattagttgctttaacgagttcatcatctactgccttgatagacttctcaatcgcatccgcgtgccatttttcaacaggtttaagactcggattttcaacaggaagaaaattcactttattgaatttccatgtatctttattacctgaactatacatccaaaatttaggatcgtttgatgagtaattggataaatttaagatatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagactgaaccgcggcaactacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcagattctttaagttaatatcagaaccttttaatcgactagcagtagacaaaatttgctttaattgtttacggaatagagcaataaatctccattcaatacgataatgatttggattgaaaaatccagatgataaatcgaccttactctgaccaacaccttgaacaaatagaggatttttataatcaatagttttacagaaatcggtgagctgttcacgagcagtcatttgagtaatatacccagcttcattaaaattacgcacccattcactgctgttcagatgtttaaaggcgtgaatggaacaattaactttaccaaggtctaaattattttcacacaaaaatgtcatagcatcacgagtatagctggcattacgaaccatatcttcaatttgagaacgagttttcatagtgttccttaagatttaagtaaatcaacaattttaattaatttttcacgctcagatttagctttactactcaatccagatagtctgaaaatttcatcgtcatattgttgaatagaaatattcagctcttcaatttgcttattaaaataatcaatttgttcagaatgtttttcgttactacgaactggtacaggttttgtaggcaatttagttgaactggattcatccgggcgataaattaaaatacaacttgaaccaatcggacatttagcaccagatgaatattctaatgttccggcttcttttaaaacttcaaaagctaaacagagatgatgccccatattaacataatctgtagagtgagctctgatataataatcatcgccacgaatactaaatttaaagcatttaaggtcttctgtattattagttttaaaaatcatctgtttatctaaacctttagctaatcgagcgcctaatgctaataatcgtcgttgattttcccacaaatctgcgatcatttggtcaaatgataatttcggcattagtcgaccataaaggtcatatcctttattataattgcgaaggatttcactcgcattaatacgagacaacgctccaattttattaagggctttcatgatgcgattagataaacccattccagacccatttgttcgttgtaaatgtttttctaatccaaatccaatatcaactttaaatttatctaaaatttcagcatgaacatctctgtcaataacattcaaatccaaagttgggttaaatctatgaaaaaatttatctggctctccacgacgaagtacagtccattcatttaattttttattaactaaagatttaattactgcattgacattattaattactactgacatatttttctcactcaattttcaattttactaaatacacagaatatgatggaaaagactatataagcaccgcatacagattgaactaataccattccaaagaaccaaacaatattatcaaacaatgtctgttttacgtcgaaaggacgtaaacttacagtaatattatcgcctttttctattgatgaatacatctctggtgaaatatattcactaaatctataaccgtctttgagttcatatacggcaataaacgataaactagacccctttccttgagttcctgtaagggtattaactacagtaacatcataatctttataatgcatataatcattaattgcataataaccatatgcaactactacacataaacaacatatcaataaattcaatcttttaattatcaactgtttcataataatctcaattaaaagggcttagaaccattataccatccttggtataaagcggttatgcgagtaccgtctttaaccgttcttcaaatttccgaagagtgttctggcgttcagctctttgctttttataagtttcaatacgctctgaaatgagagtgtatcgttcatttactgattctttcataaaatcaggaatttcacgagaagctttaatctcgtcaaatttatcaataactgcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgagatttgtaaatttgtcctccgtcaaccgtgatttcacctccgattgagatgtcattaaagaacttgctttgtgcttcagatttaaatttaccatcattgtagtttaccaagttgaaaatatctttagcattcatttttgttcctccgtagttgatagttgtatagtaccacagaggaatggtcttgtaaaccactaaaagaaacttctttcacaattttttccactgaaccaagcgctcactgctttcttagtctcaggagcagtgttatccataaaccattcaaaagcagcctttttatgattctggagggcttctcgggctttaatctgctcacggtctattaacactaacatatgagcctttcttgtcaccaagggcttcttatgattcttggagtattcccagtcatttgtccaacgcattgtcgttgcgaactgatgaaccgcgtctttaattttagtttcgtaaatttcacgagcctttgagtataacatcactacctccatttaccagtttaattctaatcatctttttgatggcagtccatataatctatttctgaactgcctttttgtcatagaaggcctcttatgaattatttcagaagagtaacctcagcgatttcttcccaaccgtttttgtcggtcataataaagtcagcaagataaagtgcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaaccgagcgggaaactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcagtgctccagcagactttgcgggtctctccggtgtccagagcagctttcagaagattaagaatgtccatatcagagaaaacatccacatcatcaatcaaaagtacagaattctcttcacgattattccaaagctgctcataaagaccaataccagagattttaccattaatgcttttatattcaatgtatccaatatcatttgctttatttaaagctttatctaaagaatacgttttaccaatacccgccgcaccagagataattaatgaacgaatgtttccgttaataataccattcgtcatcattcccataacattaaatcttttattaatgcgggttttcatatcttcatacgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaaatccgtatcagttgatagttgtatagtaccataaagctttatgtttgtaaaccgttttgtgaaaaatttttgaaataaaaaaaaagggagcccgaaggctccctatcatttataataacttcggtggttttcaagatagaccttctcaaggaagtcatcccagaaacccatgtctactttttgctgcataccgttcttagaagcttcagtagatgctgcttctacttgatcgaccacatcttccaaaaactcttgaacagttttaaatggatgtttacccaacttcacgtcgagaataaatggagcgtcttgaagtggatagactaagtcaccagttttgtaaatttccaatagttggagtccaccacggcaagcatgactcagagctttccagtcaatgccctcattcgcttcagccttacgagcacgttcgccgtattcagcatcaagtttattcaaagattgcttaagctcaataagagaaagtgttgtttgatatttacgacccaacacagtgtagaacgtttgtgggcctgttttctcatgattatggaatacccattcacagaattcgttctctggaagacgatgcttaatatcttcaactttagttcgacgctgcttaatggaaccgtcttcttggtaatcaacccattgctcagggatttgattaactactttcaatacatcacgtaatgcggccaaacgagaacccttaacaccgtatttagaagcttgcttgcgaacatatcctaaataggatttcatgttagtcgtataaaaacgagaacgattatcttggataaacttccatacatcaggcaaatcagatttaaccactagttcaggcggagtgtgaagcatatccaatgctacagtttcaccatctgccgctaatttaaagaaatacttaagactgtatagttcatggtcaatatcatctttagtgtttttagatgatgtgttgttagtgtttttgctcatatgctctttaacatttccgataagaatatcgcgagcaggaggaacaaaaatttctttaaaatctacatcagattctggagtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaataagcaaaatggcaagtataaatgctgatggaataagagtccataaactaccaaaaataagccatttctgtatgatttctgcgcagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttctccattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataaccttgccaacttgtaaaccattaaatgacgttttcaataaaattctgaagctttgtgtgagcatcaaccatgattttcatttcttcctttgcgaaagctgtacctctttccctagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccatcgtatgagtatccttcacaatgctcaactgctaattgatatgaatctatttcaacatcacgtgctaatttaataattttttcaaactgttcacgtgttagcatacttaaactctcgtattatgatcgataatttcatcaagaaacatatctaaagcttctacagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgtgatcaatcattctaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttgttttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggtgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaataatgtatcgtttttgtatctgcttgatttatctctttctccgtctttatatgcatatattaatttctgcgcaaattcagcttggcatgctttatttttcccacaataatccgcggcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaaccagctttaacattccatcccgaattataagaggatattgcttttcttatatcgcccttatgtatatttaaccaataagaaagttcaatgtacgcccaggaagctgaattggatcgtttattcaacattctttttatttcagcatcggtcatattataaccaagttccttaactcttgctcgcatagtaggcaaataattttggaacattccataagcgtgatgctttggtttagattttaaattaactccgccagagctttcttgccataaaatggctgccattatatggcctaatccgctcttgtggatgtttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctgcattgaagtgacgggtttttgaacttctcattaggcttacaaaccgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgcgtatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattagtatttttcctctggttggaacacagcacgacaagcccacatactggcttctttgagtttcgttttagcaatagctaactgatcgaggctttcagcataattcttcgcgagttcaaagtcttcgcaattatctagtgcttcccagaattcatcatataaagcatcaaagataagtcctaaacgaacttcagcgtctttaatagcatttactttaccgattttttcgtcggtatgtggcttataacctttaatatcttcaatcatatttgacttcctcaccagtacataaatcgtattcaactaaacgaataggttcatgaatgccatatccctgaacagaaatttctgtcgtaggataaattccactaatatcacccatattccacgcttcattaaattgctgttcgcctgaattactaaaccattctgcgaaagcatttaacacatctttagaaccttcaataattatctttgccattacaagctctcagtaaaggtacgagattttaactgtaggctgtggctcaatttcaatttcacgggcatgcaaaccgtagaaaatttctgggtctacaaaagagtccactttaaaggttttagagacaataattcgtgcttgaataccatcttcaaaataaatagtacctttatgtgtgccttcaagaatttgatatgctttcatataacctcaattagaaaataattttatccaagattgttctttaattaaaaatggctcagaatcatatgccattaaactttgagtaattaatcctttaaatggtccatcaataaattccatggtaaaatatggaattttattcattaatcttgcattaggagcagtgcacaaaactctgcatcctttgaatacacctttttgtaatttgtattgcttgggataaaattcgctcaagacgttgttatttgccaaaatttcaaaatgattcaccaatttatttttaatagtttttggcgaaaaataaagatattcgaaaagttgcgtatctgtcatcattgcattccaattacgaaaaactgcggacgagtaataccgccaatgcagcatttactattgcagcagtgttgcacagtttcaatatgaatatcgtaaatcttatccatatcaggagatttgacaggctcatcaattatatacaaaattcgcgaaagcgataaacctctgaacttgcttcctttattaccaataaaactgcgtacagaatcagtaaataaacgaaaacgtatatcatcattagaataacgtgaaaattcctttttaatgttatttgcagaaattttagcgtaagctgaagtattagaaagaacaataactgttccgccatcatacaaccaattagcagcaaagttagtcacagcaattgatttaccagattgacgtccaccgtctagtcgaagtgtgcaatactgtttaagcaagtcttcaaatggcaggatatattcgtttttacaaatttcttctactctagcatcagaatggtgtgtaaaagcattcatcagggatagataaggaccagttaaaaatgttctcattttattctctctaaatttgggccattccatggcgcatgaattgtccatttctgtatttacccattaccgcacttgggctcgaccttattacaggttggtgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaatagctttatagatttttatacgcgtcccaagttccagttctaaacgttgcaatgactcgttttgcgcggttaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccaatgccaatagtgtaataaccttctgtgtctttatagattttaagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaatcaacaaatttttcatatcttcggaacaaccattccagtcaactctatcaactgaaatgccatcatccccatcatctaaatcataccagcgagtttttaaaatcatttaattttcctacaatcactcacaaactctttcattgactcattttcaatataagacatgtagctattatattcttttaattgtattttgtaatctttttttctttgccaatttattttaaaattatcataatgaaaatataaaatgataccaaagaatgaaaacaatgaaataattttagtataacaaagctcactccaaacttctgttatatttactgtgccgtcgatgtttaaaataagacagtcaattaacaatccaaaaagactacctgcaagagctgcagccaacgccacagcaaaaattaaaaatgactcagaaaacgaatatttgactttatttagttttggcttttgcatcgtgattccttaacaaatttcataatttcatcaaattcatacgcagcaagtttaagctgatgttcctttttaatctttttacactgtgctttccaatcacgtacgcgtttacgataatgccttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttaattcatacttcaacggtttacttggaaggtatagtgatggctttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttgaaactcttcaaacattgaattgaaatcactttgcattttcattcctatttactccaagtaataggggcccgaagccccttatcattatttcagagaattaatatattcctgaacatcggcagaggtagtttcaaccccagaaatattaccattaaaggtttcaactcgagcaagagtatcttcaatatcaaccttagtcagtgctgcaatttcaactacatcatcagcagtactaattccaagggcattcgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggaccgataactttaatatcattcactgtacgaccgaaatcttctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgtgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagataacggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggagtggtggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcagcccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaacacattttctgctgtagtcaataatccacatataaatccaacaaacattgaaaaactaaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcagtaattttgttaaatgctacgaaattaactgattcttttccttcgtcatcaaaaacaaacacacctttaattgggcttttaccattaagatagcaaaatgcttgttccataatcataattacttctaatttagtcaaattcaaattagtctcacgatcatagtcaattccttcaaactctctacgagttaagcaaggatagtcagtgtttgctgcaaatacaccccatgcataagccaatgcatctttaataggaccagcaagttgatatttaactgcagaataattattcatgataaaatctgcagtagtatcttttccactacgctttacaccacttaaaaagattagtttcatgtgtttctcctcaaatttagttaagattataacacatgaaactgaagcattaaacttctgctataattttgccatctttttctacttgaaaatacgtataaggaatcgttgctgtgcatactaaagctgggtctgaatcttccgtgtagctaaattctacttcagacaggtcagaaacccaaggcttataaaaatttattgacatcacgatttcagttttactattatctaaaatgtaaagcgtaatgtattcaggacctgttttttgggcagtattttcgcctgtaagatagttactagttcctagcatccattcatacattcctatccacgacttaagctcttcgtcaactataaatctcacgatgagtggatcgtattcaaatgtaactcctggacgttgtgctctgcctagtccaaacggcccagtcacggtatcagtaacaggtatcctaattcctggaataggaactgactgagcatttaaagtaaaagcagatgtagtattactatgtggtattgatactacaaagttagttgtatttgcttggttaaaaatttgttgcagagcttgcgacatatattcctcataatgctttataactgttggtggtataatgggtctaagtcccttccattcaattccatttagaacaaacaacagaaaagaatggaagataatagaattaaatatttgaccagactttgtttgcagagaaacgttttccttttgaaacgaactgctgaagtggcatcaatacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgaatattgctttaaaagctcttctaggaattgctggcgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcacgcaatgtttgcctgaatgaatttatcataagcagttgtctttcttgcttattgagtttattcattggttttgattcaagcttttgaatcttttcagctgttttaattcctgaagcatattttgacattgccgaagtaaacgtagagtatttgattcctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgtcagaattctaaattttattccacgcttttcagctaaagcttgagctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgattacgtacttattatatcaaaggttcaccacgcccggaagaattagcaaatactatatatggaaatccacagttgtattgggttttattgatgtgtaatgataattatgacccatattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgaaatgcttcgccgtgatgaaggattaagattaaaagtttattgggataccgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcagatgggtgttggtggtgtagctaaatttaacacaatgttaactgctatgttagcaggagattgggaaaaagcgtataaagctggtcgtgattcattatggtatcaacaaacaaaaggccgtgcatcccgtgttaccatgattattcttacgggaaatttagaatcatatggcgttgaagtgaaaaccccagctaggtctctatcagcaatggctgctactgtagctaaatcttctgaccctgctgaccctcctattccaaatgactcgagaattttattcaaagaaccagtttcttcatataaaggtgaatatccttatgtgcatacaatggaaactgaaagtggacatattcaggaatttgatgatacccctgggcaagaacgatacagattagttcatccaactggaacttatgaagaagtatcaccgtcaggaagaagaacaagaaaaactgttgataatttgtatgatataaccaacgctgatggtaattttttggtagccggtgataaaaagactaacgtcggtggatcagaaatttattacaacatggataatcgtcttcaccagatagatggaagcaatacaatatttgtacgtggcgacgaaacgaaaactgttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataagtgtgttactgccggccatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagcggttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgcgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggcgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatttccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactatgcagaaccattctttaactggtctaaaaagtctaatacacggtgctggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggggctggtactgaatatgacataatcgttcaatctgattctttgactgaagatttagtaggacaaacgatttatacagccacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacatacagagactataattaataaatacaaaaactataaatgggattctggattgcctactgaatatgctgatagagtagctaaattaactccaaccggtgaaattgagtatgattcagtaacaggcgaagcaatttatgagcctggcccaatggctggtgtagaatatcctcttcctgatgactataatgctgaaaataataattcaatatttcaaggtcaattgccgtctgaacgacgtaaattaatgagtcccctatttgatgcttctggaacaacatttgcgcaatttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgctgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaagttcttccatcaatgcttgatgctgttattcctcgcagagattggggagatactagatatccggatccatacacatttagaattaacgatattgtagtgtgtaactcagctccttacaacgctactgaatcaggcgcaggctggttagtatatcgttgtttagatgttcctgataccggaatgtgttcaatagcatctttaactaataaggatgaatgcctcaaattaggcggaaaatggactccttctgttaggtcaatgactcctcctgaaggtcgaggagatgcggaaggaacaatcgaacctggagacggatatgtttgggaatatctttttgagattccgcccgatgtatctataaatagatgcacaaatgaatatatcgtagttccttggcctgaggaattaaaagaagacccaactagatgggggtatgaagataatctcacttggcaacaagatgattttggattaatttaccgggttaaggcaaatactatccgttttaaagcatatttagattcagtttactttcctgatgctgcattgccaggaaataaaggatttagacaaatatcaataatcacaaatcctcttgaagctaaagctcatccaaatgacccaaatgttaaagctgaaaaggattattatgatccagaagatttaatgaggcattcgggcgaaatgatttatatggaaaataggccacctattatcatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactggatattatcaaaagcactctatcgcggagtacgcaactccagtgaaagttggcactagacatgatattgatacctctactgtaggtgttaaagttattattgaaagaggagaacttggcgattgtgttgaattcattaactctaatggatcaatatcagttactaatcctttaacgattcaggctattgattcaattaaaggtgtttcgggtaatttggtagtaactagcccatatagtaaagttactttacgttgtatttcatctgataattctacgtcagtttggaattattctattgaaagtatgtttggccaaaaggaatcaccggccgaaggtacatggaatatttctacatctgggtcagttgacattccattgtttcatcgtactgaatataacatggctaaattgttagttacatgccaatcagtagatggaagaaaaattaaaacggcagaaataaatattcttgtagatactgttaattcagcggtcatttcttctgaatatgctgtcatgcgggttggaaatgaaacagaagaagacgaaatcgctaatattgcatttagtattaaagaaaattatgtaacggcaactataagttcttcaactgtcggtatgagagcagcagttaaagttatcgctacgcagaaaatcggggtggctcaataatgaaacaaaatattaatatcggtaatgttgttgatgatggtaccggtgactacctgcgtaaaggtggtataaaaataaatgaaaactttgatgaactttattatgaacttggcgatggagatgttccatattcagccggtgcctggaaaacttataatgcttcatccggtcaaacattaaaagctaagtggggaaaatcatacgctattaatacctcttctggaagagtaactttacaacttcctaaaggaactgttaatgattataataaagtaattagagctagggatgtatttgcaacatggaacattaatccagttactttagtagctgcttctggggatacaattaaagggtcgtcatcgtcagttgaaattaatattcaatttagtgatttagagctcgtttattgtgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgcggtaacgaattatattacggcgatgtatttagtgaaaacagtgactttggctctcctggggaaaatgaaggagaattaattcctcttgatggatttaatattaggttaagacagccttgtaatattggcgacactgttcaaattgaaacgtttatggatggtgtatcacaatggagaagttcatatacaagacgccaaataaaagtgttagattcaaaactaacatcaaagacttctttagaaggaagcatttatgttactgatttatcggcgatgaaatcaattccattttcagcttttggattaattcctggcgaacccattaatcctaattctcttgaggttcgttttaatggaattttacagcaacaggctggaacagctgggtatcctctgtttttgtgcgaaggcgctaattcagatacgcaagaaggatgtatatctcttggtggcgaatggaaagaatcaaatacagattattctatagaatatgaagatggaaaacctaccagtcttttatttgatagaaaatttgaatcaggcgatataatcgttataacgtggttcaataatgatttaggaactcttttagaaaaagatgacatcattgaattgactgatgaccgttatgttagcaaaggatcgtctaccgaagttactggcgatgtagccttaacagattttgataaaattggctggccaaatgttgaaaaagttgattcttatactagaacgtataattcaatatcatctattttcgatagcatttatcctgtaggttcaatttatgaaaatgctataaacccaaataatccggtgacttatatggggtttggttcgtggaaattatttggtaaaggacaagttttagtaggatggaatgatgatgttacagatccaaactttgcattaaacaataatgatttagattctagcggaaatccttcacacactgccggtggaacagttggaacaacgtcagtaacgcttgaaaatgcaaatcttcctgcgactaaaactgacgaaagagttttaattgaagatgaaaatggatcagttattattggaggttgtcaatatgacccagatgaaactggtcctatatatacaaaatatcgtgaagactatgcaacaacaaactcttcacatactcctcctactaatattagtaatattcaaccgtctattactgtataccgttggataaggattgcataatgagtttacttaataataaagcgggagttatttcccgcttagcggattttcttggttttagaactaagaaaaatgatatttcgattatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacaaaccgactattggtcatttgaaggaactgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttacgctagatagtcacacacaacctacagtattttattattttgagagagtagcatgagtaacaatacatatcagcacgtatcaaatgaatcaaaatatgttaaattcgatccagtaggatcgaattttcctggcactgttacgacagtacagtctgcattatcaaaaataagtaatatcggcgtaaatggtattcctgatgcaactatggaagttaaaggaatagcaatgattgcgtcagaacaagaggttttagatggaactaataactctaaaatcgttacaccagctacattagcaacaagattattgtatccaaatgctactgaaactaaatatggtttaacgcgttattcaacaaatgaagaaacattaaaaggctcagataataattcatcaataacaccacaaaaactgaaataccacactgacgatgtgttcaaaaatagatattcgtctgagtcatcaaacggggttattaaaatatcatctacacctgcagctttggctggagttgatgatactactgcgatgactccgctaaaaacccaaaaacttgcaataaaattaatttcgcaaatagctccttcagaagacactgcaacagaatcggtgagaggagtagttcaattatctactgttgcacaaattcgtcaaggaactctccgcgaaggatatgcaatttccccgtatacctttatgaattctgttgcaacacatgaatataagggtgttatacgcctaggaacgcagactgaaattaataataatttgggtggtgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaatgtagttggaacaagatttggtggcgattggaataatcctggcgttcctgatatgcggggtcttttcgtcagaggagccggcacaggcggtcatattttaaatcaacgtggacaagatggctatggaaaggatagactgggcgtaggatgtgacggaatgcatgttggtggtgttcaggcacaacaaatgtcataccataaacatgctggtggttggggtgaatattacagaagtgaaggcccatttggcgcgtcagtttatcaaggatatcttggaactagaaaatattccgactgggataatgcttcatacttcactaatgatggatttgaattaggtggaccgagagatgctcatggtacacttaatcgtgaaggattaattggttatgaaactagaccatggaatatatcattaaactatattattaaagttcattactaaggattacaaatgattgaattaaaagagttaccttttgttgatagcgttcctgacgaaggtcaggaacgtatttcatggattaaaaatggtgaagaaatattaggagctagtactaagtatggaaatgatggatcaatgaatagaccaattgtttccgtgtttaaaaacgtcgaagttcttgatgaaaatgtgggaattcttaaaactgccattgaaacatcacagaaagatattaaaacaattcaaggagttttagatgtatcaggagatatagaagcactatcgcagatcagtgttaataaaaatgacatatcgaatttaaagacacttaccagtgaacacactgatatattaactggaactaataatacagttgacaaaattattgctgatataggtccatttaatgatgaagaaaactctgtttatagaacaattagaaatgatttattgtggattaaacaggaattaggacaatattctggccaagacattaacggtcttcctgttgttggtaatgctagcacaggaatgaaacacagaataataacaaatagtacattattatcttcacagggcattcgtttaagcgaattagaaaataaatttactgaatctgacgtaggatcattaactgttgaagttggtaaattacgtgatgaacttggtaataaaccagtagattttgggccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggtagtcacgcatgaagtaaatacagctaaagacaatatatcctctttacagagcagcgttcaagctctacaagaagcaggttatattcctgaagctccaaaagatggccaagcttacgttcgtaaagacggcgaatgggtactactttctacctttttatcaccagcataacatggggccgcagggccccaaaggattttaaatgtcaggatataattctcagaatccaaaggaactcaaagatgtcattctaagacgtttaggggctccaattatcaatgttgagttaacacccgatcaaatttatgattgcatccagcgtgccctagaattatacggtgaataccattttgatggacttaacaaaggttttcatgtattttatgtaggagatgacgaagaaaaatataaaaccggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgagttgttggtcaagatccgaatgttaaacagggtgcttataataatcgttgggtgaaagactatgctacagctttagctaaagaattgaatggtcaaattttagcacgtcatcaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggccaaaacgctattcgtaaaattacagcaggtaaattcatttattctggagaagaaattaatccagttctacagaaaaatgaaggaattaacattccagaatttagtgaattagaattaaatcctgttcgcaatcttaacggtattcatgacattaatattgatcagtatgctgaagtagatcaaattaattctgaagctaaagaatatgttgaaccttatgttgttgtcaataacagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataatgctccatttaaaacaaacattttaaatcagaatttactgcaaaaaggcgcaacttctgtagtatcacagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaatcgaatggtcactaacatttgaagtaaacggatggatgtatcctccagtagatgatgcagaaggattaattcgtactacttatacagattttcacgccaatacaagagatttgcctgatggcgaaggtgtttttgaatctgttgatagcgaagttgttcctcgagatattaacccagaggactgggatggaacagtaaaacaaactttcactagcaatgtaaatagaccaacaccgccagaacctcctggcccaagaacatagaggttatt

What is claimed is:

1. A composition comprising (a) bacteriophage ES17, (b) bacteriophage ES19, (c) bacteriophage HP3, (d) bacteriophage HP3.1, and (e) bacteriophage HP3.2.

2. The composition of claim 1, further comprising one or more metals.

3. The composition of claim 2, wherein the one or more metals comprise calcium, magnesium, iron, sodium, and/or potassium.

19. The method of claim 11, wherein the individual has a catheter-associated urinary tract infection.

20. The method of claim 11, wherein the *E. coli* is multidrug-resistant.

21. The method of claim 11, wherein the *E. coli* is an extraintestinal pathogenic *E. coli*.

22. The method of claim 11, wherein the *E. coli* is ST69, ST73, ST96, or ST131.

23. The method of claim 11, wherein the individual has a urinary tract infection, neonatal meningitis, a blood-stream infection, pneumonia, sepsis, a surgical wound infection, a skin infection, a prostate infection, meningitis, a vaginal infection or a combination thereof.

24. The method of claim 11, wherein the individual has diarrhea, stomach cramping, nausea, and/or vomiting.

25. The method of claim 11, wherein the individual is immunosuppressed.

26. The method of claim 11, wherein the individual is administered the composition prior to a medical procedure or regimen.

27. The composition of claim 1, wherein bacteriophage ES 17 comprises SEQ ID NO:3, bacteriophage ES19 comprises SEQ ID NO:7, bacteriophage HP3 comprises SEQ ID NO: 4, bacteriophage HP3.1 comprises SEQ ID NO:5, and bacteriophage HP3.2 comprises SEQ ID NO:6.

28. A catheter comprising the composition of claim 1.

29. A composition comprising bacteriophage HP3.1.

\* \* \* \* \*